United States Patent
Weiner et al.

(10) Patent No.: US 8,735,107 B2
(45) Date of Patent: May 27, 2014

(54) LYASE ENZYMES, NUCLEIC ACIDS ENCODING THEM AND METHODS FOR MAKING AND USING THEM

(75) Inventors: David P. Weiner, San Diego, CA (US); Alexander Varvak, San Diego, CA (US); Toby Richardson, San Diego, CA (US); Mircea Podar, San Diego, CA (US); Ellen Burke, San Diego, CA (US); Shaun Healey, Carlsbad, CA (US)

(73) Assignee: Verenium Corporation, San Diego, CA (US)

( * ) Notice: Subject to any disclaimer, the term of this patent is extended or adjusted under 35 U.S.C. 154(b) by 43 days.

(21) Appl. No.: 13/287,567

(22) Filed: Nov. 2, 2011

(65) Prior Publication Data

US 2012/0177722 A1 Jul. 12, 2012

Related U.S. Application Data

(62) Division of application No. 11/817,997, filed as application No. PCT/US2006/008722 on Mar. 10, 2006, now abandoned.

(60) Provisional application No. 60/660,849, filed on Mar. 10, 2005.

(51) Int. Cl.
*C12P 13/24* (2006.01)
*C12P 13/22* (2006.01)

(52) U.S. Cl.
USPC .......................... 435/108; 435/107

(58) Field of Classification Search
CPC ............... C12P 7/22; C12P 7/42; C12N 9/88
USPC ................. 435/136, 146, 156, 232
See application file for complete search history.

(56) References Cited

U.S. PATENT DOCUMENTS

| | | | |
|---|---|---|---|
| 6,468,964 B1 | 10/2002 | Rowe | |
| 7,314,974 B2 | 1/2008 | Cao | |
| 2002/0182201 A1 | 12/2002 | Zhang-Sun | |
| 2003/0233675 A1 | 12/2003 | Cao | |
| 2004/0248118 A1 | 12/2004 | Aoki | |

FOREIGN PATENT DOCUMENTS

| | | | |
|---|---|---|---|
| WO | 0179469 A2 | 10/2001 | |
| WO | 2005104785 A2 | 11/2005 | |

OTHER PUBLICATIONS

Witkowski et al. Biochemistry. Sep. 7, 1999; 38(36): 11643-50.*
Seffernick et al. J Bacteriol. Apr. 2001; 183 (8): 2405-10.*
Baedeker—European Journal of Biochemistry (2002)-269-1790-1797.
Baedeker—Structure (2002)-10-61-67.
Calabrese—Biochemistry (2004)-43-11403-11416.
CIPO—Nov. 20, 2012—Office Action—2,614,769.
Daniel—Current Opinion in Biotechnology (2004)-15-199-204.
Dixon—Trends in Plant Science (1999)-4-394-400.
EMBL Accession No. AE017340, Idiomarina Ioihiensis L2TR (2004).
EPO—EP 78735016—Extended EP Search Report—Oct. 22, 2009.
EPO—EP675483487—Extended EP Search Report—Oct. 30, 2009.
Ferrer—Current Opinion in Biotechnology (2005)-16-588-593.
GenBank Accession No. CR378675, Photobacterium Profundum SS9, Vezzi et al. (2005).
Geneseq Accession No. ADS24623, Protein (2004).
Geneseq Accession No. ADS61699, cDNA (2004).
Gloge—Chemistry—A European Journal (2000)-6-3386-3390.
Hou—PNAS (2004)-101-18036-18041.
Ikeda—Amino Acids (2005)-29-283-287.
Kyndt—FEBS Letters (2002)-512-240-244.
Levy—Structure (2002)-10-105-113.
Lorenz—Current Opinion in Biotechnology (2002)-13-572-577.
ISA/US—PCT/US2006/08722—International Search Report & Written Opinion—Aug. 18, 2008.
ISA/US—PCT/US2007/69877—International Search Report & Written Opinion—Nov. 10, 2008.
Poppe—Current Organic Chemistry (2003)-7-1297-1315.
Rother—European Journal of Biochemistry (2002)-269-3065-3075.
Schwede—Biochemistry (1999)-38-5355-5361.
Shi—Biochemistry (1997)-36-9136-9144.
Uniprot Accession No. Q5QXE5, Histidine ammonia-lyase (2005).
Uniprot Accession No. Q7MMJ6-CHEN (2003).
Uniprot Accession No. Q8DFZ8-RHEE—(2003).
USPTO—Jun. 2, 2011—Office Action—U.S. Appl. No. 11/817,997.
USPTO—Feb. 24, 2012—Restriction Requirement (Form 892)—U.S. Appl. No. 12/303,088.
Valenzuela—Biotechnology Advances (2006)-24-197-211.
Wang—Molecular Genetics and Metabolism (2005)-86-134-140.

* cited by examiner

*Primary Examiner* — Tekchand Saidha
*Assistant Examiner* — Md. Younus Meah
(74) *Attorney, Agent, or Firm* — Justin H. Cross, Esq.; Verenium Corporation

(57) ABSTRACT

This invention provides polypeptides having lyase activity, polynucleotides encoding these polypeptides, and methods of making and using these polynucleotides and polypeptides. In one aspect, the invention is directed to polypeptides having ammonia lyase activity, e.g., phenylalanine ammonia lyase, tyrosine ammonia lyase and/or histidine ammonia lyase activity, including thermostable and thermotolerant activity, and polynucleotides encoding these enzymes, and making and using these polynucleotides and polypeptides. The polypeptides of the invention can be used in a variety of pharmaceutical, agricultural and industrial contexts.

$X = NO_2$, Cl, Br, $NH_2$, OH, H, alkyl at one or several o, m, and p positions R=H or alkyl.

1 Claim, 30 Drawing Sheets

X = NO₂, Cl, Br, F, NH₂, OH, H, alkyl at one or several *o*, *m*, and *p* positions
R = H or alkyl Mechanism B X = NO₂, Cl, Br, F, NH₂, OH, H, alkyl at one or several *o*, *m*, and *p* positions
R = H or alkyl

FIGURE 8

Table 1

| SEQ ID NO: | L-His Activity | L-Phe Activity | L-Tyr Activity | Source organism | Top hit GenBank Accession No. | GenBank organism | % protein identity | Public activity annotation | Notes |
|---|---|---|---|---|---|---|---|---|---|
| 1, 2 | y | Y | y Y | Tannerella forsythensis ATCC 43037 | gnl\|TIGR_2032 75\|contig:5077 | Tannerella forsythensis | 100 | no annotation yet | |
| 11, 12 | --- | Y | --- | Anabaena variabilis ATCC 29413 | ZP_00158715 | Anabaena variabilis ATCC 29413 | 100 | COG2986: Histidine ammonia-lyase | |
| 13, 14 | Y (weak) | --- | --- | Streptomyces carzinostaticus subsp. neocarzinostaticus ATCC 15944 | AAM77981 | Streptomyces carzinostaticus subsp. Neocarzinostaticus | 100 | aminotransferase | |
| 15, 16 | --- | --- | --- | Shewanella oneidensis ATCC 700550 (MR-1) | NP_718853 | Shewanella oneidensis MR-1 | 100 | Pal/histidase family protein | |
| 17, 18 | Y | --- | --- | Unknown | YP_077020.1 | Symbiobacterium thermophilum IAM 14863 | 55 | n/a | |
| 19, 20 | Y | --- | --- | Bacteria | NP_824501.1 | Streptomyces avermitilis MA-4680 | 88 | n/a | |
| 21, 22 | Y | --- | --- | Unknown | NP_622497.1 | Thermoanaerobacter tengcongensis MB4 | 45 | n/a | |
| 23, 24 | --- | Y | Y | Cytophaga hutchinsonii ATCC 33406 | ZP_00310856 | Cytophaga hutchinsonii | 100 | Histidine ammonia-lyase | |
| 25, 26 | --- | Y | --- | Botrytis cinerea ATCC 70-15 | EAA49872 | Magnaporthe grisea 70-15 | 53 | n/a | |

| | | | | | | |
|---|---|---|---|---|---|---|
| 27, 28 | --- | Y | Burkholderia cepacia ATCC 17616 | ZP_00224354 | Burkholderia cepacia R1808 | 98 | COG2986: Histidine ammonia-lyase | Sequence of the invention isolated from a different strain from that of the top hit. |
| 29, 30 | --- | Y | Pseudomonas fluorescens PfO-1 | ZP_00265818 | Pseudomonas fluorescens PfO-1 | 100 | COG2986: Histidine ammonia-lyase | |
| 3, 4 | Y | Y | Wautersia metallidurans ATCC 43123 (formerly Ralstonia metallidurans CH34) | ZP_00274716 | Ralstonia metallidurans CH34 | 100 | COG2986: Histidine ammonia-lyase | |
| 31, 32 | --- | Y | Idiomarina loihiensis ATCC BAA-735 (L2TR) | YP_154526 | Idiomarina loihiensis L2TR | 100 | Histidine ammonia-lyase | |
| 33, 34 | --- | Y | Fibrobacter succinogenes ATCC 19169 | gnl\|TIGR_5937 4\|contig:-2370 | Fibrobacter succinogenes | 100 | no annotation yet | |
| 35, 36 | --- | Y | Vibrio parahaemolyticus ATCC 17802 (RIMD 2210633) | NP_797268 | Vibrio parahaemolyticus RIMD 2210633 | 99 | putative histidine ammonia-lyase protein | |
| 37, 38 | --- | Y | Photorhabdus luminescens ATCC29999 | NP_929491 | Photorhabdus luminescens subsp. laumondii TT01 | 97 | Similar to histidine ammonia-lyase | Sequence of the invention isolated from a different strain from that of the top hit. |
| 39, 40 | --- | Y | Nostoc punctiforme strain ATCC 29133 (PCC 73102) | ZP_00105927 | Nostoc punctiforme PCC 73102 | 100 | COG2986: Histidine ammonia-lyase | |
| 41, 42 | --- | --- | Streptomyces avermitilis | BAC71216 | Streptomyces avermitilis MA-4680 | 100 | putative histidine ammonia-lyase | |

FIGURE 8 Continued

| SEQ ID | | | Source | Accession | Organism | % | Annotation | Notes |
|---|---|---|---|---|---|---|---|---|
| 43, 44 | --- | Y | Y | ATCC 55292 Ralstonia solanacearum ATCC 11696 | NP_521926 | Ralstonia solanacearum GMI1000 | 94 | probable histidine ammonia-lyase protein | Sequence of the invention isolated from a different strain from that of the top hit. |
| 45, 46 | --- | Y | Y | Pseudomonas syringae pv. Tomato ATCC BAA-871 (DC3000) | AAO58526 | Pseudomonas syringae pv. tomato str. DC3000 | 100 | histidine ammonia-lyase | |
| 47, 48 | --- | Y | Y | Shewanella oneidensis ATCC 700550 (MR-1) | NP_719898 | Shewanella oneidensis MR-1 | 100 | histidine ammonia-lyase, putative | |
| 49, 50 | Y | Y | --- | Unknown | YP_077020.1 | Symbiobacterium thermophilum IAM 14863 | 45 | n/a | |
| 5, 6 | Y (weak) | --- | --- | Shewanella oneidensis ATCC 700550 (MR-1) | NP_718622 | Shewanella oneidensis MR-1 | 99 | Pal/histidase family protein | Sequence of the invention isolated from a different strain from that of the top hit. |
| 51, 52 | --- | Y | --- | Unknown | ZP_00105927 | Nostoc punctiforme PCC 73102 | 54 | n/a | |
| 53, 54 | --- | Y | Y | Vibrio vulnificus ATCC 27562 | NP_759068 | Vibrio vulnificus CMCP6 | 99 | Histidine ammonia-lyase | Sequence of the invention isolated from a different strain from that of the top hit. |
| 7, 8 | Y | --- | --- | Unknown | NP_622497.1 | Thermoanaerobacter tengcongensis MB4 | 55 | n/a | |
| 9, 10 | --- | Y | Y | Acinetobacter sp. ATCC 33305 (ADP1) | YP_045320 | Acinetobacter sp. ADP1 | 100 | histidine ammonia-lyase protein (Histidase) | |

FIGURE 8 Continued

| SEQ ID NO: | Source | Function | Predicted EC number | Top hit GenBank - Public annotation | Top hit GenBank - organism definition | Top hit GenBank Accession No. | % protein identity |
|---|---|---|---|---|---|---|---|
| 235, 236 | Unknown | Esterase | 4.3.1.5 | hypothetical protein [Nostoc punctiforme]. | Pseudomonas fluorescens PfO-1 | 23123897 | 54 |
| 55, 56 | Unknown | Ammonia-lyase | 4.3.1.3 | putative histidine ammonia-lyase protein [Vibrio splendidus 12B01] gi|84377134|gb|EAP94004.1| putative histidine ammonia-lyase protein [Vibrio splendidus 12B01] | Photobacterium profundum SS9 | 84388067 | |
| 239, 240 | Unknown | Ammonia-lyase | 4.3.1.3 | putative histidine ammonia-lyase protein [Photobacterium profundum SS9] | Vibrio vulnificus YJ016 | 46915212 | 60 |
| 57, 58 | Unknown | Ammonia-lyase | 4.3.1.3 | putative histidine ammonia-lyase protein [Photobacterium profundum SS9] | Photobacterium profundum SS9 | 46915212 | |
| 241, 242 | Unknown | Ammonia-lyase | 4.3.1.3 | histidine ammonia-lyase [Vibrio vulnificus YJ016] | Vibrio vulnificus YJ016 | 37198001 | 61 |

FIGURE 8 Continued

| | | | | | |
|---|---|---|---|---|---|
| 251, 252 | Unknown | Ammonia-lyase | 4.3.1.3 | putative histidine ammonia-lyase protein [Vibrio splendidus 12B01] gi|84377134|gb|EAP94004.1| putative histidine ammonia-lyase protein [Vibrio splendidus 12B01] | 84388067 |
| 163, 164 | Unknown | Ammonia-lyase | 4.3.1.3 | Phenylalanine/histidine ammonia-lyase [Pseudomonas fluorescens PfO-1] | 77380664 | Photobacterium profundum SS9 | 59 |
| 165, 166 | Unknown | Ammonia-lyase | 4.3.1.3 | putative histidine ammonia-lyase protein [Photobacterium profundum SS9] | 46915212 | Pseudomonas fluorescens Pf-5 | 78 |
| 59, 60 | Unknown | Ammonia-lyase | 4.3.1.3 | putative histidine ammonia-lyase protein [Photobacterium profundum SS9] | 46915212 | Vibrio vulnificus CMCP6 | |
| 61, 62 | Unknown | Ammonia-lyase | 4.3.1.3 | Histidine ammonia-lyase [Vibrio vulnificus CMCP6] | 27359656 | Photobacterium profundum SS9 | |
| 63, 64 | Unknown | Ammonia-lyase | 4.3.1.3 | putative histidine ammonia-lyase protein [Photobacterium profundum SS9] | 46915212 | Pseudomonas syringae pv. phaseolicola 1448A | |

FIGURE 8 Continued

| | | | | | | |
|---|---|---|---|---|---|---|
| 243, 244 | Unknown | Ammonia-lyase | 4.3.1.3 | histidine ammonia-lyase [Vibrio vulnificus YJ016] | Vibrio sp. Ex25 | 37198001 | 60 |
| 167, 168 | Unknown | Ammonia-lyase | 4.3.1.3 | PaI/histidase family protein [Pseudomonas fluorescens Pf-5] | Pseudomonas fluorescens PfO-1 | 68348275 | |
| 169, 170 | Unknown | Ammonia-lyase | 4.3.1.3 | Phenylalanine/histidine ammonia-lyase [Pseudomonas fluorescens PfO-1] | Photobacterium profundum SS9 | 77380664 | 90 |
| 171, 172 | Unknown | Ammonia-lyase | 4.3.1.3 | putative histidine ammonia-lyase protein [Photobacterium profundum SS9] | Vibrio vulnificus CMCP6 | 46915212 | |
| 173, 174 | Unknown | Ammonia-lyase | 4.3.1.3 | Histidine ammonia-lyase [Vibrio vulnificus CMCP6] | Pseudomonas fluorescens PfO-1 | 27359656 | 62 |
| 175, 176 | Unknown | Ammonia-lyase | 4.3.1.3 | Phenylalanine/histidine ammonia-lyase [Pseudomonas fluorescens PfO-1] | Pseudomonas fluorescens PfO-1 | 77380664 | |
| 177, 178 | Unknown | Ammonia-lyase | 4.3.1.3 | Phenylalanine/histidine ammonia-lyase [Pseudomonas fluorescens PfO-1] | Pseudomonas fluorescens PfO-1 | 77380664 | 96 |
| 179, 180 | Unknown | Ammonia-lyase | 4.3.1.3 | Phenylalanine/histidine ammonia-lyase [Pseudomonas fluorescens PfO-1] | Pseudomonas fluorescens PfO-1 | 77380664 | 86 |

FIGURE 8 Continued

| | | | | | | |
|---|---|---|---|---|---|---|
| 245, 246 | Unknown | Ammonia-lyase | 4.3.1.3 | COG2986: Histidine ammonia-lyase [Vibrio sp. Ex25] | Vibrio splendidus 12B01 | 75855012 | 62 |
| 65, 66 | Unknown | Ammonia-lyase | 4.3.1.3 | phenylalanine ammonia-lyase/histidase family protein [Pseudomonas syringae pv. phaseolicola 1448A] | Acinetobacter sp. ADP1 | 71553756 | 63 |
| 67, 68 | Unknown | Ammonia-lyase | 4.3.1.3 | histidine ammonia-lyase protein (Histidase) [Acinetobacter sp. ADP1] | Vibrio sp. Ex25 | 49529786 | 80 |
| 69, 70 | Unknown | Ammonia-lyase | 4.3.1.3 | COG2986: Histidine ammonia-lyase [Vibrio sp. Ex25] | Shewanella amazonensis SB2B | 75855012 | |
| 181, 182 | Unknown | Ammonia-lyase | 4.3.1.3 | Phenylalanine/histidine ammonia-lyase [Pseudomonas fluorescens PfO-1] | Vibrio vulnificus CMCP6 | 77380664 | 87 |
| 183, 184 | Unknown | Ammonia-lyase | 4.3.1.3 | Histidine ammonia-lyase [Vibrio vulnificus CMCP6] | Pseudomonas fluorescens PfO-1 | 27359656 | |
| 185, 186 | Unknown | Ammonia-lyase | 4.3.1.3 | Phenylalanine/histidine ammonia-lyase [Pseudomonas fluorescens PfO-1] | Vibrio vulnificus CMCP6 | 77380664 | |

FIGURE 8 Continued

| | | | | | |
|---|---|---|---|---|---|
| 71, 72 | Unknown | Ammonia-lyase | 4.3.1.3 | Histidine ammonia-lyase [Shewanella amazonensis SB2B] gi|68517082|gb|EAN40792.1| Histidine ammonia-lyase [Shewanella amazonensis SB2B] | Pseudomonas fluorescens PfO-1 | 68545214 |
| 73, 74 | Unknown | Ammonia-lyase | 4.3.1.3 | Phenylalanine/histidine ammonia-lyase [Pseudomonas fluorescens PfO-1] | Idiomarina loihiensis L2TR | 77380664 |
| 75, 76 | Unknown | Ammonia-lyase | 4.3.1.3 | Histidine ammonia-lyase [Idiomarina loihiensis L2TR] | Photobacterium profundum SS9 | 56178255 |
| 77, 78 | Unknown | Ammonia-lyase | 4.3.1.3 | putative histidine ammonia-lyase protein [Photobacterium profundum SS9] | Pseudomonas fluorescens PfO-1 | 46915212 |
| 79, 80 | Unknown | Ammonia-lyase | 4.3.1.3 | Phenylalanine/histidine ammonia-lyase [Pseudomonas fluorescens PfO-1] | Shewanella amazonensis SB2B | 77380664 |
| 81, 82 | Unknown | Ammonia-lyase | 4.3.1.3 | Histidine ammonia-lyase [Shewanella amazonensis SB2B] gi|68517082|gb|EAN40792.1| Histidine ammonia-lyase [Shewanella amazonensis SB2B] | Pseudomonas fluorescens PfO-1 | 68545214 |

| | | | | | |
|---|---|---|---|---|---|
| 83, 84 | Unknown | Ammonia-lyase | 4.3.1.3 | Phenylalanine/histidine ammonia-lyase [Pseudomonas fluorescens PfO-1] | Pseudomonas syringae pv. phaseolicola 1448A | 77380664 |
| 85, 86 | Unknown | Ammonia-lyase | 4.3.1.3 | phenylalanine ammonia-lyase/histidase family protein [Pseudomonas syringae pv. phaseolicola 1448A] | Idiomarina loihiensis L2TR | 71553756 |
| 87, 88 | Unknown | Ammonia-lyase | 4.3.1.3 | Histidine ammonia-lyase [Idiomarina loihiensis L2TR] | Pseudomonas fluorescens PfO-1 | 56178255 |
| 187, 188 | Unknown | Ammonia-lyase | 4.3.1.3 | Histidine ammonia-lyase [Vibrio vulnificus CMCP6] | Vibrio vulnificus CMCP6 | 27359656 |
| 191, 192 | Unknown | Ammonia-lyase | 4.3.1.3 | Histidine ammonia-lyase [Idiomarina loihiensis L2TR] | Pseudomonas fluorescens PfO-1 | 56178255 |
| 89, 90 | Unknown | Ammonia-lyase | 4.3.1.3 | Phenylalanine/histidine ammonia-lyase [Pseudomonas fluorescens PfO-1] | Pseudomonas fluorescens PfO-1 | 77380664 |
| 91, 92 | Unknown | Ammonia-lyase | 4.3.1.3 | Phenylalanine/histidine ammonia-lyase [Pseudomonas fluorescens PfO-1] | Pseudomonas fluorescens PfO-1 | 77380664 |
| 199, 200 | Unknown | Ammonia-lyase | 4.3.1.3 | Phenylalanine/histidine ammonia-lyase [Pseudomonas fluorescens PfO-1] | Pseudomonas fluorescens PfO-1 | 77380664 |

FIGURE 8 Continued

| | | | | | | |
|---|---|---|---|---|---|---|
| 93, 94 | Unknown | Ammonia-lyase | 4.3.1.3 | Phenylalanine/histidine ammonia-lyase [Pseudomonas fluorescens PfO-1] | Vibrio vulnificus CMCP6 | 77380664 |
| 201, 202 | Unknown | Ammonia-lyase | 4.3.1.3 | Phenylalanine/histidine ammonia-lyase [Pseudomonas fluorescens PfO-1] | Pseudomonas fluorescens PfO-1 | 77380664 | 62 |
| 203, 204 | Unknown | Ammonia-lyase | 4.3.1.3 | Phenylalanine/histidine ammonia-lyase [Pseudomonas fluorescens PfO-1] | Acinetobacter sp. ADP1 | 77380664 | 62 |
| 95, 96 | Unknown | Ammonia-lyase | 4.3.1.3 | Histidine ammonia-lyase [Vibrio vulnificus CMCP6] | Pseudomonas fluorescens PfO-1 | 27359656 |
| 97, 98 | Unknown | Ammonia-lyase | 4.3.1.3 | Phenylalanine/histidine ammonia-lyase [Pseudomonas fluorescens PfO-1] | Vibrio vulnificus CMCP6 | 77380664 |
| 99, 100 | Unknown | Ammonia-lyase | 4.3.1.3 | Histidine ammonia-lyase [Vibrio vulnificus CMCP6] | Idiomarina loihiensis L2TR | 27359656 |
| 101, 102 | Unknown | Ammonia-lyase | 4.3.1.3 | Histidine ammonia-lyase [Idiomarina loihiensis L2TR] | Vibrio vulnificus CMCP6 | 56178255 |
| 193, 194 | Unknown | Ammonia-lyase | 4.3.1.3 | Phenylalanine/histidine ammonia-lyase [Pseudomonas fluorescens PfO-1] | Pseudomonas fluorescens PfO-1 | 77380664 | 61 |

FIGURE 8 Continued

| | | | | | |
|---|---|---|---|---|---|
| 195, 196 | Unknown | Ammonia-lyase | 4.3.1.3 | Phenylalanine/histidine ammonia-lyase [Pseudomonas fluorescens PfO-1] | Pseudomonas fluorescens PfO-1 | 77380664 | 65 |
| 189, 190 | Unknown | Ammonia-lyase | 4.3.1.3 | Histidine ammonia-lyase [Vibrio vulnificus CMCP6] | Idiomarina loihiensis L2TR | 27359656 | 63 |
| 197, 198 | Unknown | Ammonia-lyase | 4.3.1.3 | Phenylalanine/histidine ammonia-lyase [Pseudomonas fluorescens PfO-1] | Pseudomonas fluorescens PfO-1 | 77380664 | 65 |
| 115, 116 | Unknown | Ammonia-lyase | 4.3.1.3 | Histidine ammonia-lyase [Vibrio vulnificus CMCP6] | Shewanella amazonensis SB2B | 27359656 | |
| | | | | Histidine ammonia-lyase [Shewanella amazonensis SB2B] gi|68517082|gb|EAN40792.1| Histidine ammonia-lyase [Shewanella amazonensis SB2B] | | | |
| 117, 118 | Unknown | Ammonia-lyase | 4.3.1.3 | Histidine ammonia-lyase [Vibrio vulnificus CMCP6] | Pseudomonas fluorescens PfO-1 | 68545214 | |
| 103, 104 | Unknown | Ammonia-lyase | 4.3.1.3 | Histidine ammonia-lyase [Vibrio vulnificus CMCP6] | Pseudomonas fluorescens PfO-1 | 27359656 | |
| 207, 208 | Unknown | Ammonia-lyase | 4.3.1.3 | Phenylalanine/histidine ammonia-lyase [Pseudomonas fluorescens PfO-1] | Vibrio vulnificus CMCP6 | 77380664 | 64 |

FIGURE 8 Continued

| | | | | | |
|---|---|---|---|---|---|
| 105, 106 | ~~Unknown~~ | Ammonia-lyase | 4.3.1.3 | Phenylalanine/histidine ammonia-lyase [Pseudomonas fluorescens PfO-1] | Shewanella amazonensis SB2B | 77380664 | 64 |
| 119, 120 | Unknown | Ammonia-lyase | 4.3.1.3 | Phenylalanine/histidine ammonia-lyase [Pseudomonas fluorescens PfO-1] | Pseudomonas fluorescens PfO-1 | 77380664 | 98 |
| 113, 114 | Unknown | Ammonia-lyase | 4.3.1.3 | Phenylalanine/histidine ammonia-lyase [Pseudomonas fluorescens PfO-1] | Vibrio vulnificus CMCP6 | 77380664 | 98 |
| 121, 122 | Unknown | Ammonia-lyase | 4.3.1.3 | Phenylalanine/histidine ammonia-lyase [Pseudomonas fluorescens PfO-1] | Pseudomonas fluorescens Pf-5 | 77380664 | 65 |
| 107, 108 | Unknown | Ammonia-lyase | 4.3.1.3 | Histidine ammonia-lyase [Shewanella amazonensis SB2B] gi|68517082|gb|EAN40792.1| Histidine ammonia-lyase [Shewanella amazonensis SB2B] | Shewanella amazonensis SB2B | 68545214 | |
| 109, 110 | Unknown | Ammonia-lyase | 4.3.1.3 | Histidine ammonia-lyase [Shewanella amazonensis SB2B] gi|68517082|gb|EAN40792.1| Histidine ammonia-lyase [Shewanella amazonensis SB2B] | Vibrio vulnificus CMCP6 | 68545214 | |

FIGURE 8 Continued

| | | | | | | |
|---|---|---|---|---|---|---|
| 123, 124 | Unknown | Ammonia-lyase | 4.3.1.3 | Pal/histidase family protein [Pseudomonas fluorescens Pf-5] | Pseudomonas fluorescens Pf0-1 | 68348275 | |
| 111, 112 | Unknown | Ammonia-lyase | 4.3.1.3 | Histidine ammonia-lyase [Vibrio vulnificus CMCP6] | Pseudomonas fluorescens Pf0-1 | 27359656 | |
| 125, 126 | Unknown | Ammonia-lyase | 4.3.1.3 | Phenylalanine/histidine ammonia-lyase [Pseudomonas fluorescens Pf0-1] | Idiomarina loihiensis L2TR | 77380664 | 66 |
| 127, 128 | Unknown | Ammonia-lyase | 4.3.1.3 | Histidine ammonia-lyase [Idiomarina loihiensis L2TR] | Acinetobacter sp. ADP1 | 56178255 | 62 |
| 231, 232 | Unknown | Ammonia-lyase | 4.3.1.3 | Phenylalanine/histidine ammonia-lyase [Pseudomonas fluorescens Pf0-1] | Pseudomonas fluorescens Pf0-1 | 77380664 | 97 |
| 155, 156 | Unknown | Ammonia-lyase | 4.3.1.3 | Phenylalanine/histidine ammonia-lyase [Pseudomonas fluorescens Pf0-1] | Pseudomonas fluorescens Pf0-1 | 77380664 | 97 |
| 129, 130 | Unknown | Ammonia-lyase | 4.3.1.3 | histidine ammonia-lyase protein (Histidase) [Acinetobacter sp. ADP1] | Acinetobacter sp. ADP1 | 49529786 | 80 |
| 131, 132 | Unknown | Ammonia-lyase | 4.3.1.3 | histidine ammonia-lyase protein (Histidase) [Acinetobacter sp. ADP1] | Vibrio vulnificus YJ016 | 49529786 | 81 |

FIGURE 8 Continued

| | | | | | |
|---|---|---|---|---|---|
| 133, 134 | Unknown | Ammonia-lyase | 4.3.1.3 | histidine ammonia-lyase [Vibrio vulnificus YJ016] | Acinetobacter sp. ADP1 | 37198001 | 62 |
| 135, 136 | Unknown | Ammonia-lyase | 4.3.1.3 | histidine ammonia-lyase protein (Histidase) [Acinetobacter sp. ADP1] | Acinetobacter sp. ADP1 | 49529786 | 66 |
| 137, 138 | Unknown | Ammonia-lyase | 4.3.1.3 | histidine ammonia-lyase protein (Histidase) [Acinetobacter sp. ADP1] | Vibrio vulnificus CMCP6 | 49529786 | 82 |
| 247, 248 | Unknown | Ammonia-lyase | 4.3.1.3 | putative histidine ammonia-lyase protein [Vibrio splendidus 12B01] gi|84377134|gb|EAP94004.1| putative histidine ammonia-lyase protein [Vibrio splendidus 12B01] | Shewanella frigidimarina NCIMB 400 | 84388067 | 59 |
| 157, 158 | Unknown | Ammonia-lyase | 4.3.1.3 | Phenylalanine/histidine ammonia-lyase [Pseudomonas fluorescens PfO-1] | Shewanella frigidimarina NCIMB 400 | 77380664 | 97 |
| 225, 226 | Unknown | Ammonia-lyase | 4.3.1.3 | Phenylalanine/histidine ammonia-lyase [Pseudomonas fluorescens PfO-1] | Pseudomonas fluorescens PfO-1 | 77380664 | 97 |

FIGURE 8 Continued

| SEQ IDs | Organism | Enzyme | EC | Description | Source | GI | % |
|---|---|---|---|---|---|---|---|
| 151, 152 | Unknown | Ammonia-lyase | 4.3.1.3 | Phenylalanine/histidine ammonia-lyase [Pseudomonas fluorescens PfO-1] | Pseudomonas fluorescens PfO-1 | 77380664 | 95 |
| 205, 206 | Unknown | Ammonia-lyase | 4.3.1.3 | histidine ammonia-lyase protein (Histidase) [Acinetobacter sp. ADP1] | Pseudomonas fluorescens PfO-1 | 49529786 | 84 |
| 153, 154 | Pseudomonas fluorescens ATCC 13525 | Ammonia-lyase | 4.3.1.3 | Phenylalanine/histidine ammonia-lyase [Pseudomonas fluorescens PfO-1] | Pseudomonas fluorescens PfO-1 | 77380664 | 93 |
| 237, 238 | Pseudomonas fluorescens ATCC 13525 | Ammonia-lyase | 4.3.1.3 | Phenylalanine/histidine ammonia-lyase [Pseudomonas fluorescens PfO-1] | Photobacterium profundum SS9 | 77380664 | 93 |
| 161, 162 | Shewanella pealeana ATCC 700345 | Ammonia-lyase | 4.3.1.3 | Histidine ammonia-lyase [Shewanella sp. PV-4] gi\|78361053\|gb\|EAP02881.1\| Histidine ammonia-lyase [Shewanella sp. PV-4] | Pseudomonas fluorescens PfO-1 | 78366916 | |
| 143, 144 | Unknown | Ammonia-lyase | 4.3.1.3 | Phenylalanine/histidine ammonia-lyase [Pseudomonas fluorescens PfO-1] | Vibrio vulnificus CMCP6 | 77380664 | |
| 217, 218 | Unknown | Ammonia-lyase | 4.3.1.3 | histidine ammonia-lyase [Pseudomonas syringae pv. tomato str. DC3000] | Vibrio vulnificus CMCP6 | 28872212 | 62 |

FIGURE 8 Continued

| | | | | | |
|---|---|---|---|---|---|
| 219, 220 | Unknown | Ammonia-lyase | 4.3.1.3 | Histidine ammonia-lyase [Vibrio vulnificus CMCP6] | Vibrio vulnificus CMCP6 | 27359656 | 61 |
| 221, 222 | Unknown | Ammonia-lyase | 4.3.1.3 | Histidine ammonia-lyase [Vibrio vulnificus CMCP6] | Pseudomonas fluorescens PfO-1 | 27359656 | 61 |
| 145, 146 | Unknown | Ammonia-lyase | 4.3.1.3 | Histidine ammonia-lyase [Vibrio vulnificus CMCP6] | Pseudomonas fluorescens PfO-1 | 27359656 | |
| 147, 148 | Unknown | Ammonia-lyase | 4.3.1.3 | Phenylalanine/histidine ammonia-lyase [Pseudomonas fluorescens PfO-1] | Pseudomonas fluorescens PfO-1 | 77380664 | 63 |
| 141, 142 | Unknown | Ammonia-lyase | 4.3.1.3 | Histidine ammonia-lyase [Vibrio vulnificus CMCP6] | Pseudomonas fluorescens PfO-1 | 27359656 | |
| 139, 140 | Unknown | Ammonia-lyase | 4.3.1.3 | Histidine ammonia-lyase [Vibrio vulnificus CMCP6] | Vibrio vulnificus CMCP6 | 27359656 | 61 |
| 209, 210 | Unknown | Ammonia-lyase | 4.3.1.3 | Histidine ammonia-lyase [Vibrio vulnificus CMCP6] | Vibrio vulnificus CMCP6 | 27359656 | 61 |
| 211, 212 | Unknown | Ammonia-lyase | 4.3.1.3 | Histidine ammonia-lyase [Vibrio vulnificus CMCP6] | Pseudomonas fluorescens PfO-1 | 27359656 | |
| 213, 214 | Unknown | Ammonia-lyase | 4.3.1.3 | Phenylalanine/histidine ammonia-lyase [Pseudomonas fluorescens PfO-1] | Vibrio vulnificus CMCP6 | 77380664 | 64 |
| 215, 216 | Unknown | Ammonia-lyase | 4.3.1.3 | Histidine ammonia-lyase [Vibrio vulnificus CMCP6] | Pseudomonas syringae pv. tomato str. | 27359656 | 61 |

FIGURE 8 Continued

| SEQ ID NOs | Source organism | Enzyme | EC | Description | Organism | GI | % |
|---|---|---|---|---|---|---|---|
| 223, 224 | Pseudomonas stutzeri ATCC 14405 | Ammonia-lyase | 4.3.1.3 | Phenylalanine/histidine ammonia-lyase [Pseudomonas fluorescens PfO-1] | Pseudomonas fluorescens PfO-1 | 77380664 | 93 |
| | | | | | DC3000 | | |
| 159, 160 | Unknown | Ammonia-lyase | 4.3.1.3 | Histidine ammonia-lyase [Shewanella frigidimarina NCIMB 400] gi|69166270|gb|EAN75251.1| Histidine ammonia-lyase [Shewanella frigidimarina NCIMB 400] | Shewanella sp. PV-4 | 69950125 | |
| 249, 250 | Unknown | Ammonia-lyase | 4.3.1.3 | Histidine ammonia-lyase [Shewanella frigidimarina NCIMB 400] gi|69166270|gb|EAN75251.1| Histidine ammonia-lyase [Shewanella frigidimarina NCIMB 400] | Vibrio splendidus 12B01 | 69950125 | 86 |
| 149, 150 | Unknown | Ammonia-lyase | 4.3.1.3 | Phenylalanine/histidine ammonia-lyase [Pseudomonas fluorescens PfO-1] | Pseudomonas fluorescens PfO-1 | 77380664 | 85 |

FIGURE 8 Continued

| | | | | | |
|---|---|---|---|---|---|
| 233, 234 | Unknown | Ammonia-lyase | 4.3.1.3 | Phenylalanine/histidine ammonia-lyase [Pseudomonas fluorescens PfO-1] | Nostoc punctiforme | 77380664 | 91 |
| 227, 228 | Unknown | Ammonia-lyase | 4.3.1.3 | Phenylalanine/histidine ammonia-lyase [Pseudomonas fluorescens PfO-1] | Pseudomonas fluorescens PfO-1 | 77380664 | 93 |
| 229, 230 | Unknown | Ammonia-lyase | 4.3.1.3 | Phenylalanine/histidine ammonia-lyase [Pseudomonas fluorescens PfO-1] | Pseudomonas fluorescens PfO-1 | 77380664 | 93 |

Table 2

| Enzyme/initial source organism | Enzyme | Activity | Phe activity (μmol/min/mL) | o-BrPhe activity (μmol/min/mL) |
|---|---|---|---|---|
| Unknown | SEQ ID NO:52 (encoded, e.g., by SEQ ID NO:51) | PAL | | |
| Botrytis cinerea | SEQ ID NO:26 (encoded, e.g., by SEQ ID NO:25) | PAL | 0.12 | 0.11 |
| Pseudomonas fluorescens | SEQ ID NO:30 (encoded, e.g., by SEQ ID NO:29) | TAL/PAL | 0.29 | 0.51 |
| Shewanella oneidensis | SEQ ID NO:48 (encoded, e.g., by SEQ ID NO:47) | TAL/PAL | 0.38 | 0.48 |
| Ralstonia metallidurans | SEQ ID NO:4 (encoded, e.g., by SEQ ID NO:3) | TAL/PAL/HAL | 0.031 | 0.040 |
| Nostoc punctiforme | SEQ ID NO:40 (encoded, e.g., by SEQ ID NO:39) | PAL | 0.46 | 0.13 |
| Anabaena variabilis | SEQ ID NO:12 (encoded, e.g., by SEQ ID NO:11) | PAL | 2.16 | 0.67 |
| Photorhabdus luminescens | SEQ ID NO:38 (encoded, e.g., by SEQ ID NO:37) | PAL | 0.61 | 0.67 |
| Burkholderia cepacia | SEQ ID NO:28 (encoded, e.g., by SEQ ID NO:27) | TAL/PAL | 0.0044 | 0.0036 |
| Pseudomonas syringae | SEQ ID NO:46 (encoded, e.g., by SEQ ID NO:45) | TAL/PAL | 0.31 | 0.57 |
| Vibrio parahaemolyticus | SEQ ID NO:36 (encoded, e.g., by SEQ ID NO:35) | TAL/PAL | 0.13 | 0.10 |
| Idiomarina loihiensis | SEQ ID NO:32 (encoded, e.g., by SEQ ID NO:31) | TAL/PAL | 0.16 | 0.13 |
| Cytophaga hutchinsonii | SEQ ID NO:24 (encoded, e.g., by SEQ ID NO:23) | TAL/PAL | 0.022 | 0.052 |
| Ralstonia solanacearum | SEQ ID NO:44 (encoded, e.g., by SEQ ID NO:43) | TAL/PAL | 0.012 | 0.009 |
| Acinetobacter sp | SEQ ID NO:10 (encoded, e.g., by SEQ ID NO:9) | TAL/PAL | 0.0013 | 0.0011 |

| | | | |
|---|---|---|---|
| *Fibrobacter succinogens* | SEQ ID NO:34 (encoded, e.g., by SEQ ID NO:33) | TAL/PAL | 0.18 | 0.26 |
| *Tannerella forsythensis* | SEQ ID NO:2 (encoded, e.g., by SEQ ID NO:1) | TAL/PAL | N.D. | N.D. |
| *Vibrio vulnificus* | SEQ ID NO:54 (encoded, e.g., by SEQ ID NO:53) | TAL/PAL | 0.0081 | 0.0059 |

FIGURE 9 Continued

LYASE ENZYMES, NUCLEIC ACIDS ENCODING THEM AND METHODS FOR MAKING AND USING THEM

CROSS-REFERENCE TO RELATED APPLICATIONS

This application is a divisional of U.S. application Ser. No. 11/817,997, filed May 28, 2008, now abandoned; which is a National Stage Filing of International Application No.: PCT/US2006/08722, filed Mar. 10, 2006, now International Publication No.: WO 2006/099207; which claims priority of U.S. Application No. 60/660,849 Mar. 10, 2005, now expired. All of the applications listed above are hereby incorporated by reference into the specification of this application for all purposes.

REFERENCE TO SEQUENCE LISTING

This application contains a sequence listing submitted via EFS-Web as an ASCII (.txt) text file. The entire content of the sequence listing as described below is hereby incorporated by reference into the specification of this application.

| File Name | Date of Creation | Size in Bytes |
|---|---|---|
| D2160_1ND1_Substitute_SEQ_LISTING | Mar. 21, 2012 | 859,760 Bytes |

FIELD OF THE INVENTION

This invention relates to molecular and cellular biology and biochemistry. In one aspect, the invention provides polypeptides having ammonia lyase activity, e.g., phenylalanine ammonia lyase, tyrosine ammonia lyase and/or histidine ammonia lyase activity, polynucleotides encoding these polypeptides, and methods of making and using these polynucleotides and polypeptides. In one aspect, the invention is directed to polypeptides having ammonia lyase activity, e.g., phenylalanine ammonia lyase, tyrosine ammonia lyase and/or histidine ammonia lyase activity, including thermostable and thermotolerant activity, and polynucleotides encoding these enzymes, and making and using these polynucleotides and polypeptides. The polypeptides of the invention can be used in a variety of pharmaceutical, agricultural and industrial contexts.

Additionally, the polypeptides of the invention can be used in the synthesis or manufacture of phenylalanine and tyrosine as well as phenylalanine and tyrosine derivatives. Applications also include utilizing the enzymes to degrade phenylalanine, tyrosine, and derivatives thereof to manufacture cinnamic acid, para-hydroxycinnamic acid, para-hydroxyl styrene and derivatives thereof. Polypeptides of the invention can also be used in the synthesis or manufacture of ortho, meta and para isomers of phenylalanine or related compounds, as well as derivatives thereof. Polypeptides of the invention can also be used in the synthesis or manufacture of urocanoic acid and urocanoic acid derivatives, from histidine and histidine derivatives. Polypeptides of the invention can also be used in enzyme substitution therapies for the treatment of phenylketonuria (PKU). Thus, fields of use include manufacture of bulk and fine chemicals for industrial, medicinal and agricultural use, as well as the direct application of the enzymes themselves for enzyme substitution therapy for a variety of diseases.

BACKGROUND

Phenylalanine ammonia lyases (PAL, EC 4.3.1.5) catalyze the deamination of phenylalanine to trans-cinnamic acid and ammonia (FIG. 5). In nature, they facilitate the committed step in phenylpropanoid pathways to produce lignins, coumarins, and flavonoids. Depending on the source of the enzyme, PALs may show varying selectivity towards phenylalanine and tyrosine derivatives (those active on tyrosine derivatives are known as tyrosine ammonia lyases (TALs)). Histidine ammonia lyases (HALs, EC 4.3.1.3) are distinct from PALs in that they have a substrate preference for histidine over phenylalanine or tyrosine. HALs catalyze the abstraction of ammonia from histidine to form urocanoic acid.

Most of the phenylalanine ammonia lyases (PALs) currently described are from plant origins where the enzyme plays a central role in plant metabolism. Recently, PALs have been identified in fungi and a very limited number have been identified in bacteria. HALs have also been identified in plants and fungi. Unlike PALs, HALs have been found to be widespread in bacteria. Synthetic applications of HALs tend to be rather limited compared to PALs. Some niche applications have been developed such as the synthesis of radiolabeled urocanoic acids as tracers of histidine metabolism. There may be potential to expand applications of HALs by discovery of enzymes with greater stability to oxygen.

Up until the late 1990s, it was thought that histidine and phenylalanine ammonia lyases utilized a dehydroalanine cofactor in their catalytic mechanism. However X-ray crystallographic studies have shown that the cofactor is actually 3,5-dihydro-5-methylidine-4H-imidazol-4-one (MIO), which is formed by cyclization and dehydration of a conserved active site Ala-Ser-Gly sequence. Enzyme mechanistic studies have led to two main proposals on the catalytic mechanism of phenylalanine ammonia lyases (PALs), as shown in FIGS. 6a and 6b. In both mechanisms A and B, the MIO group acts as a powerful electrophile; in mechanism A the MIO group reacts with the amino group of Phe, while in mechanism B it reacts with the aromatic side chain in a Friedel-Crafts-type reaction.

Applications of PALs include the manufacture of phenylalanine and tyrosine as well as phenylalanine and tyrosine derivatives. Applications include utilizing the enzymes to degrade phenylalanine, tyrosine, and derivatives to manufacture cinnamic acid, para-hydroxycinnamic acid and derivatives. Fields of use include manufacture of bulk and fine chemicals for industrial, medicinal and agricultural use, as well as the direct application of the enzymes themselves for an enzyme substitution therapy.

For example, PALs have been investigated for an enzyme substitution therapy for the treatment of phenylketonuria (PKU), an inherited metabolic disease caused by a deficiency of the enzyme phenylalanine hydroxylase. PKU is one of the most commonly inherited metabolic disorders, affecting an estimated 50,000 people in the developed world or 30,000 people in the United States. It occurs in approximately 1 in 10,000 (0.01%) babies born in the US. PKU is an inborn error of amino acid metabolism caused by a phenylalanine hydroxylase defect (PAH). Untreated patients with PKU often show mental retardation or otherwise impaired cognitive function. Currently the only treatment for PKU is strict dietary control via a low-phenylalanine diet. A few pharmaceutical modalities to treat PKU are under investigation. One of these approaches is the use of phenylalanine ammonia-lyase (PAL) as an enzyme replacement therapy. Several reports of applying a PAL (*R. toruloides*) to decrease phenylalanine serum levels in murine models have been published. However, developing a form of this enzyme with sufficiently high activity and stability has proven difficult. One concept was the application of PAL as an oral treatment to break down phenylalanine in the gut. PAL therapy is also being considered for use with CLEC™ (crystallized enzyme crystal) methodology to stabilize the enzyme for oral delivery. Degradation of phenylalanine by PAL treatment yields trans-cinnamate which has very low toxicity. In addition, PAL therapy has the advantage that it does not require exogenous cofactors to degrade Phe. There is a need for more PAL enzymes to extend the utility of this versatile enzyme class, especially PALs of bacterial origin. Bacterial PALs potentially offer greater catalytic versatility than plant and fungal enzymes since their natural cellular roles are likely more diverse.

SUMMARY

The invention provides polypeptides, including enzymes, having ammonia lyase activity, e.g., phenylalanine ammonia lyase, tyrosine ammonia lyase and/or histidine ammonia lyase activity, nucleic acids encoding them, antibodies that bind to them, and methods of making and using them.

In one aspect, polypeptides of the invention can be used in the synthesis or manufacture of α-amino acids and derivatives or β-amino acids and derivatives, e.g. phenylalanine, histidine or tyrosine and derivatives thereof. In one aspect, the β-amino acids synthesized or manufactured using a polypeptide of the invention include phenylalanine, histidine or tyrosine and derivatives and analogs thereof, including phenylalanine, histidine or tyrosine altered by substitution with (addition of) a halogen-, methyl-, ethyl-, hydroxy-, hydroxymethyl-, nitro-, or amino-comprising group in any or all of the 2, 3, A, and 5 positions in the benzyl ring of the amino acid. For example, polypeptides of the invention can be used in the synthesis or manufacture of ortho, meta and para isomers of phenylalanine, histidine and/or tyrosine, e.g., ortho-, meta- or para-bromo phenylalanine; ortho-, meta- or para-fluoro phenylalanine; ortho-, meta- or para-iodo phenylalanine; ortho-, meta- or para-chloro phenylalanine; ortho-, meta- or para-methyl phenylalanine; ortho-, meta- or para-hydroxyl phenylalanine; ortho-, meta- or para-hydroxymethyl phenylalanine; ortho-, meta- or para-ethyl phenylalanine ortho-, meta- or para-nitro phenylalanine; ortho-, meta- or para-amino phenylalanine; ortho-, meta- or para-bromo histidine; ortho-, meta- or para-fluoro histidine; ortho-, meta- or para-iodo histidine; ortho-, meta- or para-chloro histidine; ortho-, meta- or para-methyl histidine; ortho-, meta- or para-hydroxyl histidine; ortho-, meta- or para-hydroxymethyl histidine; ortho-, meta- or para-ethyl histidine ortho-, meta- or para-nitro histidine; ortho-, meta- or para-amino histidine; ortho-, meta- or para-bromo tyrosine; ortho-, meta- or para-fluoro tyrosine; ortho-, meta- or para-iodo tyrosine; ortho-, meta- or para-chloro tyrosine; ortho-, meta- or para-methyl tyrosine; ortho-, meta- or para-hydroxyl tyrosine; ortho-, meta- or para-hydroxymethyl tyrosine; ortho-, meta- or para-ethyl tyrosine ortho-, meta- or para-nitro tyrosine; ortho-, meta- or para-amino tyrosine, all in both L and D enantiomers, such as L- and D-β-amino acids (e.g., L-phenylalanine and D-phenylalanine, L- and D-histidine, L- and D-tyrosine), as well as derivatives thereof. In one aspect, the invention provides methods for the synthesis or manufacture of L- and D-phenylalanine and L- and D-tyrosine as well as L- and D-phenylalanine and L- and D-tyrosine derivatives (see FIG. 5). In another aspect, the invention provides methods for the synthesis or manufacture of cinnamic acid and cinnamic acid derivatives. In yet another aspect, the invention provides methods for the synthesis or manufacture of para-hydroxy-cinnamic acid and para-hydroxyl styrene via biocatalytic and fermentation, hi another aspect, the invention provides methods for the synthesis or manufacture of ortho-bromo and ortho-chloro L-phenylalanine and of ortho-bromo and ortho-chloro D-phenylalanine, as well as derivatives thereof. In yet another aspect, the invention provides methods for the synthesis or manufacture of L- and D-β-amino acids (see FIGS. 6a and 6b) and L- and D-histidine and derivatives. In another aspect, the invention provides methods for the synthesis or manufacture of urocanoic acid and urocanoic acid derivatives, from histidine and histidine derivatives. In one aspect, the enzymes of the invention can be used to catalyze the reverse reaction of any of the reactions described herein.

In further aspects, the invention provides methods for the manufacture of bulk and fine chemicals for industrial, medicinal and agricultural use, using the enzymes of the invention. In other aspects, the invention provides methods of application of the enzymes of the invention for enzyme substitution therapy, e.g., using PALs for the treatment of phenylketonuria (PKU), an inherited metabolic disease caused by a deficiency of the enzyme phenylalanine hydroxylase.

hi one aspect the invention provides compositions (e.g., feeds, drugs, dietary supplements) comprising the enzymes, polypeptides or polynucleotides of the invention. These compositions can be formulated in a variety of forms, e.g., as liquids, sprays, films, micelles, liposomes, powders, food, feed pellets or encapsulated forms, including encapsulated forms.

The invention provides isolated or recombinant nucleic acids comprising a nucleic acid sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention, including SEQ ID NO:1, SEQ ID NO:3, SEQ ID NO:5, SEQ ID NO:7, SEQ ID NO:9, SEQ ID NO:11, SEQ ID NO:13, SEQ ID NO:15, SEQ ID NO:17, SEQ ID NO:19, SEQ ID NO:21, SEQ ID NO:23, SEQ ID NO:25, SEQ ID NO:27, SEQ ID NO:29, SEQ ID NO:31, SEQ ID NO:33, SEQ ID NO:35, SEQ ID NO:37, SEQ ID NO:39, SEQ ID NO:41, SEQ ID NO:43, SEQ ID NO:45, SEQ ID NO:47, SEQ ID NO:49, SEQ ID NO:51, SEQ ID NO:53, SEQ ID NO:55, SEQ ID NO:57, SEQ ID NO. 59, SEQ ID NO:61, SEQ ID NO:63, SEQ ID NO:65, SEQ ID NO:67, SEQ ID NO:69, SEQ ID NO. 71, SEQ ID NO:73, SEQ ID NO:75, SEQ ID NO:77, SEQ ID NO:79, SEQ ID NO. 81, SEQ ID NO:83, SEQ ID NO:85, SEQ ID NO:87, SEQ ID NO:89, SEQ ID NO:91, SEQ ID NO:93, SEQ ID NO:95, SEQ ID NO:97, SEQ ID NO:99, SEQ ID NO:101, SEQ ID NO:103, SEQ ID NO:105, SEQ ID NO:107, SEQ ID NO:109, SEQ ID NO:111, SEQ ID NO: 113, SEQ ID NO: 115, SEQ ID NO: 117, SEQ ID NO: 119, SEQ ID NO: 121, SEQ ID NO:123, SEQ ID NO:125, SEQ ID NO:127, SEQ ID NO:129, SEQ ID NO:131, SEQ ID NO:133, SEQ ID NO:135, SEQ ID NO:137, SEQ ID NO:139, SEQ ID NO:141, SEQ ID NO:143, SEQ ID NO:145, SEQ ID NO:147, SEQ ID NO:149, SEQ ID NO:151, SEQ ID NO: 153, SEQ ID NO: 155, SEQ ID NO: 157, SEQ ID NO: 159, SEQ ID NO: 161, SEQ ID NO:163, SEQ ID NO:165, SEQ ID NO:167, SEQ ID NO:169, SEQ ID NO:171, SEQ ID NO:173, SEQ ID NO:175, SEQ ID NO:177, SEQ ID NO:179, SEQ ID NO:181, SEQ ID NO:183, SEQ ID NO:185, SEQ ID NO:187, SEQ ID NO:189, SEQ ID NO:191, SEQ ID NO:193, SEQ ID NO:195, SEQ ID NO:197, SEQ ID NO:199, SEQ ID NO:201, SEQ ID NO:203, SEQ ID NO:205, SEQ ID NO:207, SEQ ID NO:209, SEQ ID NO:211, SEQ ID NO:213, SEQ ID NO:215, SEQ ID NO:217, SEQ ID NO:219, SEQ ID NO:221, SEQ ID NO:223, SEQ ID NO:225, SEQ ID NO:227, SEQ ID NO:229, SEQ ID NO:231, SEQ ID NO:233, SEQ ID NO:235, SEQ ID NO:237, SEQ ID NO:239, SEQ ID NO:241, SEQ ID NO:243, SEQ ID NO:245, SEQ ID NO:247, SEQ ID NO:249 and SEQ ID NO:251, over a region of at least about 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1800, 1850, 1900, 1950, 2000, 2050, 2100, 2200, 2250, 2300, 2350, 2400, 2450, 2500, or more residues, wherein the nucleic acid encodes at least one polypeptide having an ammonia lyase activity, e.g., phenylalanine ammonia lyase, tyrosine ammonia lyase and/or histidine ammonia lyase activity, or encodes a peptide or polypeptide that can be used to generate an antibody that specifically binds to an exemplary polypeptide of the invention (see below). In one aspect, the sequence identities are determined by analysis with a sequence comparison algorithm or by a visual inspection.

Exemplary nucleic acids of the invention also include isolated, synthetic or recombinant nucleic acids encoding an exemplary polypeptide of the invention, including SEQ ID NO:2, SEQ ID NO:4, SEQ ID NO:6, SEQ ID NO:8, SEQ ID NO:10, SEQ ID NO:12, SEQ ID NO:14, SEQ ID NO:16, SEQ ID NO:18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO: 100, SEQ ID NO: 102, SEQ ID NO: 104, SEQ ID NO: 106, SEQ ID NO: 108, SEQ ID NO: 110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO: 142, SEQ ID NO: 143, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO:192, SEQ ID NO:194, SEQ ID NO:196, SEQ ID NO:198, SEQ ID NO:200, SEQ ID NO:202, SEQ ID NO:204, SEQ ID NO:206, SEQ ID NO:209, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250 or SEQ ID NO:252, and subsequences thereof and variants thereof. In one aspect, the polypeptide has an ammonia lyase activity, e.g., phenylalanine ammonia lyase, tyrosine ammonia lyase and/or histidine ammonia lyase activity, or, the polypeptide or peptide has immunogenic activity.

In one aspect, the invention also provides ammonia lyase-encoding, e.g., phenylalanine ammonia lyase-, tyrosine ammonia lyase- and/or histidine ammonia lyase-encoding nucleic acids with a common novelty in that they are derived from mixed cultures. The invention provides ammonia lyase-degrading enzyme-encoding nucleic acids isolated from mixed cultures comprising a polynucleotide of the invention, e.g., a sequence having at least about 10%, 15%, 20%, 25%, 30%, 35%, 40%, 45%, 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary nucleic acid of the invention, which includes all the odd numbered sequences from SEQ ID NO:1 through SEQ ID NO:251, over a region of at least about 50, 75, 100, 150, 200, 250, 300, 350, 400, 450, 500, 550, 600, 650, 700, 750, 800, 850, 900, 950, 1000, 1050, 1100, 1150, or more, or, nucleic acids which encode an enzymatically active fragment of an exemplary sequence of the invention.

In one aspect, the invention provides ammonia lyase enzyme-, e.g., phenylalanine ammonia lyase enzyme-, tyrosine ammonia lyase enzyme- and/or histidine ammonia lyase enzyme-encoding nucleic acids, including SEQ ID NO:7, SEQ ID NO: 17, SEQ ID NO:21, SEQ ID NO:49, SEQ ID NO:51 and the polypeptides encoded by them, including SEQ ID NO:8, SEQ ID NO: 18, SEQ ID NO:22, SEQ ID NO:50, and SEQ ID NO:52 with a common novelty in that they are derived from a common source, e.g., an environmental source. In one aspect, the invention also provides ammonia lyase enzyme-, e.g., phenylalanine ammonia lyase enzyme-, tyrosine ammonia lyase enzyme- and/or histidine ammonia lyase enzyme-encoding nucleic acids with a common novelty in that they are derived from environmental sources, e.g., mixed environmental sources.

In one aspect, the sequence comparison algorithm is a BLAST version 2.2.2 algorithm where a filtering setting is set to blastall -p blastp -d "nr pataa"-F F, and all other options are set to default.

Another aspect of the invention is an isolated or recombinant nucleic acid including at least 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550, 1600, 1650, 1700, 1750, 1800, 1850, 1900, 1950, 2000, 2050, 2100, 2200, 2250, 2300, 2350, 2400, 2450, 2500, or more consecutive bases of a nucleic acid sequence of the invention, sequences substantially identical thereto, and the sequences complementary thereto.

In one aspect, the isolated or recombinant nucleic acid encodes a polypeptide having an ammonia lyase activity, e.g., phenylalanine ammonia lyase, tyrosine ammonia lyase and/or histidine ammonia lyase activity, which is thermostable. The polypeptide can retain an ammonia lyase activity under conditions comprising a temperature range of between about 37° C. to about 95° C.; between about 55° C. to about 85° C., between about 70° C. to about 95° C., or, between about 90° C. to about 95° C.

In another aspect, the isolated or recombinant nucleic acid encodes a polypeptide having an ammonia lyase activity, e.g., phenylalanine ammonia lyase, tyrosine ammonia lyase and/or histidine ammonia lyase activity, which is thermotolerant. The polypeptide can retain an ammonia lyase activity after exposure to a temperature in the range from greater than 37° C. to about 95° C. or anywhere in the range from greater than 55° C. to about 85° C. The polypeptide can retain an ammonia lyase activity after exposure to a temperature in the range between about 1° C. to about 5° C., between about 5° C. to about 15° C., between about 15° C. to about 25° C., between about 25° C. to about 37° C., between about 37° C. to about 95° C., between about 55° C. to about 85° C., between about 70° C. to about 75° C., or between about 90° C. to about 95° C., or more. In one aspect, the polypeptide retains an ammonia lyase activity after exposure to a temperature in the range from greater than 90° C. to about 95° C. at about pH 4.5.

The invention provides isolated, synthetic or recombinant nucleic acids comprising a sequence that hybridizes under stringent conditions to a nucleic acid comprising a sequence of the invention, e.g., an exemplary sequence of the invention, e.g., as set forth in SEQ ID NO:1 through SEQ ID NO:251, or fragments or subsequences thereof. In one aspect, the nucleic acid encodes a polypeptide having an ammonia lyase activity, e.g., phenylalanine ammonia lyase, tyrosine ammonia lyase and/or histidine ammonia lyase activity. The nucleic acid can be at least about 10, 15, 20, 25, 30, 35, 40, 45, 50, 75, 100, 150, 200, 250, 300, 350, 400, 450, 500, 550, 600, 650, 700, 750, 800, 850, 900, 950, 1000, 1050, 1100, 1150, 1200 or more residues in length or the full length of the gene or transcript. In one aspect, the stringent conditions include a wash step comprising a wash in 0.2×SSC at a temperature of about 65° C. for about 15 minutes.

The invention provides a nucleic acid probe for identifying a nucleic acid encoding a polypeptide having an ammonia lyase activity, e.g., phenylalanine ammonia lyase, tyrosine ammonia lyase and/or histidine ammonia lyase activity, wherein the probe comprises at least about 10, 15, 20, 25, 30, 35, 40, 45, 50, 55, 60, 65, 70, 75, 80, 85, 90, 95, 100, 150, 200, 250, 300, 350, 400, 450, 500, 550, 600, 650, 700, 750, 800, 850, 900, 950, 1000 or more, consecutive bases of a sequence comprising a sequence of the invention, or fragments or subsequences thereof, wherein the probe identifies the nucleic acid by binding or hybridization. The probe can comprise an oligonucleotide comprising at least about 10 to 50, about 20 to 60, about 30 to 70, about 40 to 80, or about 60 to 100 consecutive bases of a sequence comprising a sequence of the invention, or fragments or subsequences thereof.

The invention provides a nucleic acid probe for identifying a nucleic acid encoding a polypeptide having an ammonia lyase activity, e.g., phenylalanine ammonia lyase, tyrosine ammonia lyase and/or histidine ammonia lyase activity, wherein the probe comprises a nucleic acid comprising a sequence at least about 10, 15, 20, 30, 40, 50, 60, 70, 80, 90, 100, 150, 200, 250, 300, 350, 400, 450, 500, 550, 600, 650, 700, 750, 800, 850, 900, 950, 1000 or more residues having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to a nucleic acid of the invention. In one aspect, the sequence identities are determined by analysis with a sequence comparison algorithm or by visual inspection. In alternative aspects, the probe can comprise an oligonucleotide comprising at least about 10 to 50, about 20 to 60, about 30 to 70, about 40 to 80, or about 60 to 100, or about 50 to 150, or about 100 to 200, consecutive bases of a nucleic acid sequence of the invention, or a subsequence thereof.

The invention provides an amplification primer pair for amplifying a nucleic acid encoding a polypeptide having an ammonia lyase activity, e.g., phenylalanine ammonia lyase, tyrosine ammonia lyase and/or histidine ammonia lyase activity, wherein the primer pair is capable of amplifying a nucleic acid comprising a sequence of the invention, or fragments or subsequences thereof. One or each member of the amplification primer sequence pair can comprise an oligonucleotide comprising at least about 10 to 50, or more, consecutive bases of the sequence, or about 12, 13, 14, 15, 16, 17, 18, 19, 20, 21, 22, 23, 24, 25, 26, 27, 28, 29, 30 or more consecutive bases of the sequence.

The invention provides amplification primer pairs, wherein the primer pair comprises a first member having a sequence as set forth by about the first (the 5') 12, 13, 14, 15, 16, 17, 18, 19, 20, 21, 22, 23, 24, 25, 26, 27, 28, 29, 30, 31, 32, 33, 34, 35, 36 or more residues of a nucleic acid of the invention, and a second member having a sequence as set forth by about the first (the 5') 12, 13, 14, 15, 16, 17, 18, 19, 20, 21, 22, 23, 24, 25, 26, 27, 28, 29, 30, 31, 32, 33, 34, 35, 36 or more residues of the complementary strand of the first member.

The invention provides ammonia lyase-encoding, e.g., phenylalanine ammonia lyase-, tyrosine ammonia lyase- and/or histidine ammonia lyase-encoding nucleic acids generated by amplification, e.g., polymerase chain reaction (PCR), using an amplification primer pair of the invention. The invention provides ammonia lyase-encoding, e.g., phenylalanine ammonia lyase-, tyrosine ammonia lyase- and/or histidine ammonia lyase-encoding nucleic acids generated by amplification, e.g., polymerase chain reaction (PCR), using an amplification primer pair of the invention. The invention provides methods of making an ammonia lyase, e.g., phenylalanine ammonia lyase, tyrosine ammonia lyase and/or histidine ammonia lyase enzyme by amplification, e.g., polymerase chain reaction (PCR), using an amplification primer pair of the invention. In one aspect, the amplification primer pair amplifies a nucleic acid from a library, e.g., a gene library, such as an environmental library.

The invention provides methods of amplifying a nucleic acid encoding a polypeptide having an ammonia lyase activity, e.g., phenylalanine ammonia lyase, tyrosine ammonia lyase and/or histidine ammonia lyase activity comprising amplification of a template nucleic acid with an amplification primer sequence pair capable of amplifying a nucleic acid sequence of the invention, or fragments or subsequences thereof.

The invention provides expression cassettes comprising a nucleic acid of the invention or a subsequence thereof. In one aspect, the expression cassette can comprise the nucleic acid that is operably linked to a promoter. The promoter can be a viral, fungal, yeast, bacterial, mammalian or plant promoter. In one aspect, the plant promoter can be a potato, rice, corn, wheat, tobacco or barley promoter. The promoter can be a constitutive promoter. The constitutive promoter can comprise CaMV35S. In another aspect, the promoter can be an inducible promoter. In one aspect, the promoter can be a tissue-specific promoter or an environmentally regulated or a developmentally regulated promoter. Thus, the promoter can be, e.g., a seed-specific, a leaf-specific, a root-specific, a stem-specific or an abscission-induced promoter. In one aspect, the expression cassette can further comprise a plant or plant virus expression vector.

The invention provides cloning vehicles comprising an expression cassette (e.g., a vector) of the invention or a nucleic acid of the invention. The cloning vehicle can be a viral vector, a plasmid, a phage, a phagemid, a cosmid, a fosmid, a bacteriophage or an artificial chromosome. The viral vector can comprise an adenovirus vector, a retroviral vector or an adeno-associated viral vector. The cloning vehicle can comprise a bacterial artificial chromosome (BAC), a plasmid, a bacteriophage P1-derived vector (PAC), a yeast artificial chromosome (YAC), or a mammalian artificial chromosome (MAC).

The invention provides transformed cell comprising a nucleic acid of the invention or an expression cassette (e.g., a vector) of the invention, or a cloning vehicle of the invention. In one aspect, the transformed cell can be a bacterial cell, a mammalian cell, a fungal cell, a yeast cell, an insect cell or a plant cell. In one aspect, the plant cell can be a cereal, a potato, wheat, rice, corn, tobacco or barley cell.

The invention provides transgenic non-human animals comprising a nucleic acid of the invention or an expression cassette (e.g., a vector) of the invention. In one aspect, the animal is a mouse, a rat, a pig, a goat or a sheep.

The invention provides transgenic plants comprising a nucleic acid of the invention or an expression cassette (e.g., a vector) of the invention. The transgenic plant can be a cereal plant, a corn plant, a potato plant, a tomato plant, a wheat plant, an oilseed plant, a rapeseed plant, a soybean plant, a rice plant, a barley plant or a tobacco plant.

The invention provides transgenic seeds comprising a nucleic acid of the invention or an expression cassette (e.g., a vector) of the invention. The transgenic seed can be a cereal plant, a corn seed, a wheat kernel, an oilseed, a rapeseed, a soybean seed, a palm kernel, a sunflower seed, a sesame seed, a peanut or a tobacco plant seed.

The invention provides an antisense oligonucleotide comprising a nucleic acid sequence complementary to or capable of hybridizing under stringent conditions to a nucleic acid of the invention. The invention provides methods of inhibiting the translation of an ammonia lyase, e.g., phenylalanine ammonia lyase, tyrosine ammonia lyase and/or histidine ammonia lyase enzyme message in a cell comprising administering to the cell or expressing in the cell an antisense oligonucleotide comprising a nucleic acid sequence complementary to or capable of hybridizing under stringent conditions to a nucleic acid of the invention. In one aspect, the antisense oligonucleotide is between about 10 to 50, about 20 to 60, about 30 to 70, about 40 to 80, or about 60 to 100 bases in length, e.g., 10, 15, 20, 25, 30, 35, 40, 45, 50, 55, 60, 65, 70, 75, 80, 85, 90, 95, 100 or more bases in length.

The invention provides methods of inhibiting the translation of an ammonia lyase enzyme, e.g., phenylalanine ammonia lyase, tyrosine ammonia lyase and/or histidine ammonia lyase enzyme message in a cell comprising administering to the cell or expressing in the cell an antisense oligonucleotide comprising a nucleic acid sequence complementary to or capable of hybridizing under stringent conditions to a nucleic acid of the invention. The invention provides double-stranded inhibitory RNA (RNAi, or RNA interference) molecules (including small interfering RNA, or siRNAs, for inhibiting transcription, and microRNAs, or miRNAs, for inhibiting translation) comprising a subsequence of a sequence of the invention. In one aspect, the siRNA is between about 21 to 24 residues, or, about at least 15, 16, 17, 18, 19, 20, 21, 22, 23, 24, 25, 26, 27, 28, 29, 30, 31, 32, 33, 34, 35, 40, 45, 50, 55, 60, 65, 70, 75, 80, 85, 90, 95, 100 or more duplex nucleotides in length. The invention provides methods of inhibiting the expression of an ammonia lyase enzyme, e.g., phenylalanine ammonia lyase, tyrosine ammonia lyase and/or histidine ammonia lyase enzyme in a cell comprising administering to the cell or expressing in the cell a double-stranded inhibitory RNA (siRNA or miRNA), wherein the RNA comprises a subsequence of a sequence of the invention.

The invention provides an isolated or recombinant polypeptide comprising an amino acid sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary polypeptide or peptide of the invention over a region of at least about 10, 15, 20, 25, 30, 35, 40, 45, 50, 55, 60, 65, 70, 75, 80, 85, 90, 95, 100, 125, 150, 175, 200, 225, 250, 275, 300, 325, 350 or more residues, or over the full length of the polypeptide. In one aspect, the sequence identities are determined by analysis with a sequence comparison algorithm or by a visual inspection. Exemplary polypeptide or peptide sequences of the invention include SEQ ID NO:2, SEQ ID NO:4, SEQ ID NO:6, SEQ ID NO:8, SEQ ID NO: 10, SEQ ID NO:12, SEQ ID NO: 14, SEQ ID NO: 16, SEQ ID NO: 18, SEQ ID NO:20, SEQ ID NO:22, SEQ ID NO:24, SEQ ID NO:26, SEQ ID NO:28, SEQ ID NO:30, SEQ ID NO:32, SEQ ID NO:34, SEQ ID NO:36, SEQ ID NO:38, SEQ ID NO:40, SEQ ID NO:42, SEQ ID NO:44, SEQ ID NO:46, SEQ ID NO:48, SEQ ID NO:50, SEQ ID NO:52, SEQ ID NO:54, SEQ ID NO:56, SEQ ID NO:58, SEQ ID NO:60, SEQ ID NO:62, SEQ ID NO:64, SEQ ID NO:66, SEQ ID NO:68, SEQ ID NO:70, SEQ ID NO:72, SEQ ID NO:74, SEQ ID NO:76, SEQ ID NO:78, SEQ ID NO:80, SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:122, SEQ ID NO:124, SEQ ID NO:126, SEQ ID NO:128, SEQ ID NO:130, SEQ ID NO:132, SEQ ID NO:134, SEQ ID NO:136, SEQ ID NO:138, SEQ ID NO:140, SEQ ID NO:142, SEQ ID NO:143, SEQ ID NO:146, SEQ ID NO:148, SEQ ID NO:150, SEQ ID NO:152, SEQ ID NO: 154, SEQ ID NO: 156, SEQ ID NO: 158, SEQ ID NO: 160, SEQ ID NO: 162, SEQ ID NO:164, SEQ ID NO:166, SEQ ID NO:168, SEQ ID NO:170, SEQ ID NO:172, SEQ ID NO:174, SEQ ID NO:176, SEQ ID NO:178, SEQ ID NO:180, SEQ ID NO:182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO:200, SEQ ID NO:202, SEQ ID NO:204, SEQ ID NO:206, SEQ ID NO:209, SEQ ID NO:210, SEQ ID NO:212, SEQ ID NO:214, SEQ ID NO:216, SEQ ID NO:218, SEQ ID NO:220, SEQ ID NO:222, SEQ ID NO:224, SEQ ID NO:226, SEQ ID NO:228, SEQ ID NO:230, SEQ ID NO:232, SEQ ID NO:234, SEQ ID NO:236, SEQ ID NO:238, SEQ ID NO:240, SEQ ID NO:242, SEQ ID NO:244, SEQ ID NO:246, SEQ ID NO:248, SEQ ID NO:250 and SEQ ID NO:252, and subsequences thereof and variants thereof. Exemplary polypeptides also include fragments of at least about 10, 15, 20, 25, 30, 35, 40, 45, 50, 75, 80, 85, 90, 95, 100, 125, 150, 175, 200, 250, 300, 350, 400, 450, 500, 550, 600 or more residues in length, or over the full length of an enzyme. Exemplary polypeptide or peptide sequences of the invention include sequence encoded by a nucleic acid of the invention. Exemplary polypeptide or peptide sequences of the invention include polypeptides or peptides specifically bound by an antibody of the invention, or a peptide or polypeptide has immunogenic activity, e.g., the peptide or polypeptide can be used to generate an antibody that specifically binds to an exemplary polypeptide of the invention.

In one aspect, a polypeptide of the invention has at least one ammonia lyase enzyme, e.g., phenylalanine ammonia lyase, tyrosine ammonia lyase and/or histidine ammonia lyase enzyme activity. In alternative aspects, a polynucleotide of the invention encodes a polypeptide that has at least one ammonia lyase enzyme, e.g., phenylalanine ammonia lyase, tyrosine ammonia lyase and/or histidine ammonia lyase enzyme activity.

In one aspect, the ammonia lyase, e.g., phenylalanine ammonia lyase, tyrosine ammonia lyase and/or histidine ammonia lyase enzyme activity is thermostable. The polypeptide can retain an ammonia lyase, e.g., phenylalanine ammonia lyase, tyrosine ammonia lyase and/or histidine ammonia lyase enzyme activity under conditions comprising a temperature range of between about 1° C. to about 5° C., between about 5° C. to about 15° C., between about 15° C. to about 25° C., between about 25° C. to about 37° C., between about 37° C. to about 95° C., between about 55° C. to about 85° C., between about 70° C. to about 75° C., or between about 90° C. to about 95° C., or more.

In another aspect, the ammonia lyase, e.g., phenylalanine ammonia lyase, tyrosine ammonia lyase and/or histidine ammonia lyase enzyme activity can be thermotolerant. The polypeptide can retain an ammonia lyase, e.g., phenylalanine ammonia lyase, tyrosine ammonia lyase and/or histidine ammonia lyase enzyme activity after exposure to a temperature in the range from greater than 37° C. to about 95° C., or in the range from greater than 55° C. to about 85° C. The polypeptide can retain an ammonia lyase, e.g., phenylalanine ammonia lyase, tyrosine ammonia lyase and/or histidine ammonia lyase enzyme activity after exposure to conditions comprising a temperature range of between about 1° C. to about 5° C., between about 5° C. to about 15° C., between about 15° C. to about 25° C., between about 25° C. to about 37° C., between about 37° C. to about 95° C., between about 55° C. to about 85° C., between about 70° C. to about 75° C., or between about 90° C. to about 95° C., or more. In one aspect, the polypeptide can retain an ammonia lyase, e.g., phenylalanine ammonia lyase, tyrosine ammonia lyase and/or histidine ammonia lyase enzyme activity after exposure to a temperature in the range from greater than 90° C. to about 95° C. at pH 4.5.

Another aspect of the invention provides an isolated or recombinant polypeptide or peptide including at least 10, 15, 20, 25, 30, 35, 40, 45, 50, 55, 60, 65, 70, 75, 80, 85, 90, 95 or 100 or more consecutive bases of a polypeptide or peptide sequence of the invention, sequences substantially identical thereto, and the sequences complementary thereto. The peptide can be, e.g., an immunogenic fragment, a motif (e.g., a binding site), a signal sequence, a prepro sequence or an active site.

The invention provides isolated or recombinant nucleic acids comprising a sequence encoding a polypeptide having an ammonia lyase, e.g., phenylalanine ammonia lyase, tyrosine ammonia lyase and/or histidine ammonia lyase enzyme activity and a signal sequence, wherein the nucleic acid comprises a sequence of the invention. By a "signal sequence" is meant a secretion signal or other domain that facilitates secretion of a polypeptide, e.g., a lyase, of the invention from the host cell. The signal sequence can be derived from another enzyme (e.g., another ammonia lyase, phenylalanine ammonia lyase, tyrosine ammonia lyase and/or histidine ammonia lyase enzyme; or the signal sequence can be derived from a non-ammonia lyase, e.g., non-phenylalanine ammonia lyase, non-tyrosine ammonia lyase and/or non-histidine ammonia lyase enzyme; or, a completely heterologous enzyme. The invention provides isolated or recombinant nucleic acids comprising a sequence encoding a polypeptide having an ammonia lyase, e.g., phenylalanine ammonia lyase, tyrosine ammonia lyase and/or histidine ammonia lyase enzyme activity, wherein the sequence does not contain a signal sequence and the nucleic acid comprises a sequence of the invention. In one aspect, the invention provides an isolated or recombinant polypeptide comprising a polypeptide of the invention lacking all or part of a signal sequence. In one aspect, the isolated or recombinant polypeptide can comprise the polypeptide of the invention comprising a heterologous signal sequence, such as a heterologous ammonia lyase, e.g., phenylalanine ammonia lyase, tyrosine ammonia lyase and/or histidine ammonia lyase enzyme signal sequence or non-ammonia lyase, e.g., non-phenylalanine ammonia lyase, non-tyrosine ammonia lyase and/or non-histidine ammonia lyase enzyme signal sequence.

In one aspect, the invention provides chimeric proteins comprising a first domain comprising a signal sequence of the invention and at least a second domain. The protein can be a fusion protein. The second domain can comprise an enzyme (where in one aspect the first domain is a polypeptide of the invention). The protein can be a non-enzyme.

The invention provides chimeric polypeptides comprising at least a first domain comprising signal peptide (SP), a prepro sequence and/or a catalytic domain (CD) of the invention and at least a second domain comprising a heterologous polypeptide or peptide, wherein the heterologous polypeptide or peptide is not naturally associated with the signal peptide (SP), prepro sequence and/or catalytic domain (CD). In one aspect, the heterologous polypeptide or peptide is not an ammonia lyase, e.g., phenylalanine ammonia lyase, tyrosine ammonia lyase and/or histidine ammonia lyase enzyme. The heterologous polypeptide or peptide can be amino terminal to, carboxy terminal to or on both ends of the signal peptide (SP), prepro sequence and/or catalytic domain (CD).

The invention provides isolated or recombinant nucleic acids encoding a chimeric polypeptide, wherein the chimeric polypeptide comprises at least a first domain comprising signal peptide (SP), a prepro domain and/or a catalytic domain (CD) of the invention and at least a second domain comprising a heterologous polypeptide or peptide, wherein the heterologous polypeptide or peptide is not naturally associated with the signal peptide (SP), prepro domain and/or catalytic domain (CD).

The invention provides isolated or recombinant signal sequences (e.g., signal peptides) consisting of or comprising a sequence as set forth in residues 1 to 10, 1 to 11, 1 to 12, 1 to 13, 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 28, 1 to 30, 1 to 31, 1 to 32, 1 to 33, 1 to 34, 1 to 35, 1 to 36, 1 to 37, 1 to 38, 1 to 40, 1 to 41, 1 to 42, 1 to 43, 1 to 44, 1 to 45, 1 to 46 or 1 to 47, of a polypeptide of the invention, e.g., an exemplary polypeptide of the invention, including all even numbered sequences between SEQ ID NO:2 and SEQ ID NO:252. In one aspect, the invention provides signal sequences comprising the first 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70 or more amino terminal residues of a polypeptide of the invention.

In one aspect, the ammonia lyase, e.g., phenylalanine ammonia lyase, tyrosine ammonia lyase and/or histidine ammonia lyase enzyme activity comprises a specific activity at about 37° C. in the range from about 1 to about 1200 units per milligram of protein, or, about 100 to about 1000 units per milligram of protein. In another aspect, the ammonia lyase, e.g., phenylalanine ammonia lyase, tyrosine ammonia lyase and/or histidine ammonia lyase enzyme activity comprises a specific activity from about 100 to about 1000 units per milligram of protein, or, from about 500 to about 750 units per milligram of protein. Alternatively, the ammonia lyase, e.g., phenylalanine ammonia lyase, tyrosine ammonia lyase and/or histidine ammonia lyase enzyme activity comprises a specific activity at 37° C. in the range from about 1 to about 750 units per milligram of protein, or, from about 500 to about 1200 units per milligram of protein. In one aspect, the ammonia lyase, e.g., phenylalanine ammonia lyase, tyrosine ammonia lyase and/or histidine ammonia lyase enzyme activity comprises a specific activity at 37° C. in the range from about 1 to about 500 units per milligram of protein, or, from about 750 to about 1000 units per milligram of protein. In another aspect, the ammonia lyase, e.g., phenylalanine ammonia lyase, tyrosine ammonia lyase and/or histidine ammonia lyase enzyme activity comprises a specific activity at 37° C. in the range from about 1 to about 250 units per milligram of protein. Alternatively, the ammonia lyase, e.g., phenylalanine ammonia lyase, tyrosine ammonia lyase and/or histidine ammonia lyase enzyme activity comprises a specific activity at 37° C. in the range from about 1 to about 100 units per milligram of protein.

In another aspect, the thermotolerance comprises retention of at least half of the specific activity of the ammonia lyase, e.g., phenylalanine ammonia lyase, tyrosine ammonia lyase and/or histidine ammonia lyase enzyme at 37° C. after being heated to the elevated temperature. Alternatively, the thermotolerance can comprise retention of specific activity at 37° C. in the range from about 1 to about 1200 units per milligram of protein, or, from about 500 to about 1000 units per milligram of protein, after being heated to the elevated temperature. In another aspect, the thermotolerance can comprise retention of specific activity at 37° C. in the range from about 1 to about 500 units per milligram of protein after being heated to the elevated temperature.

The invention provides the isolated or recombinant polypeptide of the invention, wherein the polypeptide comprises at least one glycosylation site. In one aspect, glycosylation can be an N-linked glycosylation. In one aspect, the polypeptide can be glycosylated after being expressed in a *P. pastoris* or a *S. pombe* host or in any mammalian, fungal, bacterial, insect, yeast or other host cell.

In one aspect, the polypeptide can retain ammonia lyase, e.g., phenylalanine ammonia lyase, tyrosine ammonia lyase and/or histidine ammonia lyase enzyme activity under conditions comprising about pH 6.5, pH 6, pH 5.5, pH 5, pH 4.5 or pH 4. In another aspect, the polypeptide can retain an ammonia lyase, e.g., phenylalanine ammonia lyase, tyrosine ammonia lyase and/or histidine ammonia lyase enzyme activity under conditions comprising about pH 7, pH 7.5 pH 8.0, pH 8.5, pH 9, pH 9.5, pH 10, pH 10.5 or pH 11. In one aspect, the polypeptide can retain an ammonia lyase, e.g., phenylalanine ammonia lyase, tyrosine ammonia lyase and/or histidine ammonia lyase enzyme activity after exposure to conditions comprising about pH 6.5, pH 6, pH 5.5, pH 5, pH 4.5 or pH 4 or more acidic conditions. In another aspect, the polypeptide can retain an ammonia lyase, e.g., phenylalanine ammonia lyase, tyrosine ammonia lyase and/or histidine ammonia lyase enzyme activity after exposure to conditions comprising about pH 7, pH 7.5 pH 8.0, pH 8.5, pH 9, pH 9.5, pH 10, pH 10.5 or pH 11 or more alkaline conditions.

In one aspect, the ammonia lyase, e.g., phenylalanine ammonia lyase, tyrosine ammonia lyase and/or histidine ammonia lyase enzyme of the invention has activity at under alkaline conditions, e.g., the alkaline conditions of the gut, e.g., the small intestine. In one aspect, the polypeptide can retains activity after exposure to the acidic pH of the stomach.

The invention provides protein preparations comprising a polypeptide of the invention, wherein the protein preparation comprises a liquid, a solid or a gel.

The invention provides heterodimers comprising a polypeptide of the invention and a second protein or domain. The second member of the heterodimer can be a different ammonia lyase, e.g., phenylalanine ammonia lyase, tyrosine ammonia lyase and/or histidine ammonia lyase enzyme, a different enzyme or another protein, hi one aspect, the second domain can be a polypeptide and the heterodimer can be a fusion protein. In one aspect, the second domain can be an epitope or a tag. In one aspect, the invention provides homo-multimers, including, but not limited to, homodimers, homotrimers, homotetramers, homopentamers, and homohexamers, etc., comprising a polypeptide of the invention.

The invention provides immobilized polypeptides having ammonia lyase, e.g., phenylalanine ammonia lyase, tyrosine ammonia lyase and/or histidine ammonia lyase enzyme activity, wherein the polypeptide comprises a polypeptide of the invention, a polypeptide encoded by a nucleic acid of the invention, or a polypeptide comprising a polypeptide of the invention and a second domain. In one aspect, the polypeptide can be immobilized on a cell, a metal, a resin, a polymer, a ceramic, a glass, a microelectrode, a graphitic particle, a bead, a gel, a plate, an array or a capillary tube.

The invention provides arrays comprising an immobilized nucleic acid of the invention. The invention provides arrays comprising an antibody of the invention.

The invention provides isolated or recombinant antibodies that specifically bind to a polypeptide of the invention or to a polypeptide encoded by a nucleic acid of the invention. These antibodies of the invention can be a monoclonal or a polyclonal antibody. The invention provides hybridomas comprising an antibody of the invention, e.g., an antibody that specifically binds to a polypeptide of the invention or to a polypeptide encoded by a nucleic acid of the invention. The invention provides nucleic acids encoding these antibodies.

The invention provides method of isolating or identifying a polypeptide having ammonia lyase, e.g., phenylalanine ammonia lyase, tyrosine ammonia lyase and/or histidine ammonia lyase enzyme activity comprising the steps of: (a) providing an antibody of the invention; (b) providing a sample comprising polypeptides; and (c) contacting the sample of step (b) with the antibody of step (a) under conditions wherein the antibody can specifically bind to the polypeptide, thereby isolating or identifying a polypeptide having an ammonia lyase, e.g., phenylalanine ammonia lyase, tyrosine ammonia lyase and/or histidine ammonia lyase enzyme activity.

The invention provides methods of making an anti-ammonia lyase, e.g., anti-phenylalanine ammonia lyase, anti-tyrosine ammonia lyase and/or anti-histidine ammonia lyase enzyme antibody comprising administering to a non-human animal a nucleic acid of the invention or a polypeptide of the invention or subsequences thereof in an amount sufficient to generate a humoral immune response, thereby making an anti-ammonia lyase, e.g., anti-phenylalanine ammonia lyase, anti-tyrosine ammonia lyase and/or anti-histidine ammonia lyase enzyme antibody. The invention provides methods of making an anti-ammonia lyase, e.g., anti-phenylalanine ammonia lyase, anti-tyrosine ammonia lyase and/or anti-histidine ammonia lyase enzyme immune comprising administering to a non-human animal a nucleic acid of the invention or a polypeptide of the invention or subsequences thereof in an amount sufficient to generate an immune response.

The invention provides methods of producing a recombinant polypeptide comprising the steps of: (a) providing a nucleic acid of the invention operably linked to a promoter; and (b) expressing the nucleic acid of step (a) under conditions that allow expression of the polypeptide, thereby producing a recombinant polypeptide. In one aspect, the method can further comprise transforming a host cell with the nucleic acid of step (a) followed by expressing the nucleic acid of step (a), thereby producing a recombinant polypeptide in a transformed cell.

The invention provides methods for identifying a polypeptide having ammonia lyase, e.g., phenylalanine ammonia lyase, tyrosine ammonia lyase and/or histidine ammonia lyase enzyme activity comprising the following steps: (a) providing a polypeptide of the invention; or a polypeptide encoded by a nucleic acid of the invention; (b) providing ammonia lyase, e.g., phenylalanine ammonia lyase, tyrosine ammonia lyase and/or histidine ammonia lyase enzyme substrate; and (c) contacting the polypeptide or a fragment or variant thereof of step (a) with the substrate of step (b) and detecting a decrease in the amount of substrate or an increase in the amount of a reaction product, wherein a decrease in the amount of the substrate or an increase in the amount of the reaction product detects a polypeptide having an ammonia lyase, e.g., phenylalanine ammonia lyase, tyrosine ammonia lyase and/or histidine ammonia lyase enzyme activity. In one aspect, the substrate is a histidine-, phenylalanine- or tyrosine-comprising compound.

The invention provides methods for identifying ammonia lyase, e.g., phenylalanine ammonia lyase, tyrosine ammonia lyase and/or histidine ammonia lyase enzyme substrate comprising the following steps: (a) providing a polypeptide of the invention; or a polypeptide encoded by a nucleic acid of the invention; (b) providing a test substrate; and (c) contacting the polypeptide of step (a) with the test substrate of step (b) and detecting a decrease in the amount of substrate or an increase in the amount of reaction product, wherein a decrease in the amount of the substrate or an increase in the amount of a reaction product identifies the test substrate as an ammonia lyase, e.g., phenylalanine ammonia lyase, tyrosine ammonia lyase and/or histidine ammonia lyase enzyme substrate.

The invention provides methods of determining whether a test compound specifically binds to a polypeptide comprising the following steps: (a) expressing a nucleic acid or a vector comprising the nucleic acid under conditions permissive for translation of the nucleic acid to a polypeptide, wherein the nucleic acid comprises a nucleic acid of the invention, or, providing a polypeptide of the invention; (b) providing a test compound; (c) contacting the polypeptide with the test compound; and (d) determining whether the test compound of step (b) specifically binds to the polypeptide.

The invention provides methods for identifying a modulator of an ammonia lyase, e.g., phenylalanine ammonia lyase, tyrosine ammonia lyase and/or histidine ammonia lyase enzyme activity comprising the following steps: (a) providing a polypeptide of the invention or a polypeptide encoded by a nucleic acid of the invention; (b) providing a test compound; (c) contacting the polypeptide of step (a) with the test compound of step (b) and measuring an activity of the ammonia lyase, e.g., phenylalanine ammonia lyase, tyrosine ammonia lyase and/or histidine ammonia lyase enzyme, wherein a change in the ammonia lyase, e.g., phenylalanine ammonia lyase, tyrosine ammonia lyase and/or histidine ammonia lyase enzyme activity measured in the presence of the test compound compared to the activity in the absence of the test compound provides a determination that the test compound modulates the ammonia lyase, e.g., phenylalanine ammonia lyase, tyrosine ammonia lyase and/or histidine ammonia lyase enzyme activity. In one aspect, the ammonia lyase, e.g., phenylalanine ammonia lyase, tyrosine ammonia lyase and/or histidine ammonia lyase enzyme activity can be measured by providing an ammonia lyase, e.g., phenylalanine ammonia lyase, tyrosine ammonia lyase and/or histidine ammonia lyase enzyme substrate and detecting a decrease in the amount of the substrate or an increase in the amount of a reaction product, or, an increase in the amount of the substrate or a decrease in the amount of a reaction product. A decrease in the amount of the substrate or an increase in the amount of the reaction product with the test compound as compared to the amount of substrate or reaction product without the test compound identifies the test compound as an activator of ammonia lyase, e.g., phenylalanine ammonia lyase, tyrosine ammonia lyase and/or histidine ammonia lyase enzyme activity. An increase in the amount of the substrate or a decrease in the amount of the reaction product with the test compound as compared to the amount of substrate or reaction product without the test compound identifies the test compound as an inhibitor of ammonia lyase, e.g., phenylalanine ammonia lyase, tyrosine ammonia lyase and/or histidine ammonia lyase enzyme activity.

The invention provides computer systems comprising a processor and a data storage device wherein said data storage device has stored thereon a polypeptide sequence or a nucleic acid sequence of the invention (e.g., a polypeptide encoded by a nucleic acid of the invention). In one aspect, the computer system can further comprise a sequence comparison algorithm and a data storage device having at least one reference sequence stored thereon. In another aspect, the sequence comparison algorithm comprises a computer program that indicates polymorphisms. In one aspect, the computer system can further comprise an identifier that identifies one or more features in said sequence. The invention provides computer readable media having stored thereon a polypeptide sequence or a nucleic acid sequence of the invention. The invention provides methods for identifying a feature in a sequence comprising the steps of: (a) reading the sequence using a computer program which identifies one or more features in a sequence, wherein the sequence comprises a polypeptide sequence or a nucleic acid sequence of the invention; and (b) identifying one or more features in the sequence with the computer program. The invention provides methods for comparing a first sequence to a second sequence comprising the steps of: (a) reading the first sequence and the second sequence through use of a computer program which compares sequences, wherein the first sequence comprises a polypeptide sequence or a nucleic acid sequence of the invention; and (b) determining differences between the first sequence and the second sequence with the computer program. The step of determining differences between the first sequence and the second sequence can further comprise the step of identifying polymorphisms. In one aspect, the method can further comprise an identifier that identifies one or more features in a sequence. In another aspect, the method can comprise reading the first sequence using a computer program and identifying one or more features in the sequence.

The invention provides methods for isolating or recovering a nucleic acid encoding a polypeptide having an ammonia lyase, e.g., phenylalanine ammonia lyase, tyrosine ammonia lyase and/or histidine ammonia lyase enzyme activity from a sample, such as an environmental sample comprising the steps of: (a) providing an amplification primer sequence pair for amplifying a nucleic acid encoding a polypeptide having an ammonia lyase, e.g., phenylalanine ammonia lyase, tyrosine ammonia lyase and/or histidine ammonia lyase enzyme activity, wherein the primer pair is capable of amplifying a nucleic acid of the invention; (b) isolating a nucleic acid from the sample or treating the sample such that nucleic acid in the sample is accessible for hybridization to the amplification primer pair; and, (c) combining the nucleic acid of step (b) with the amplification primer pair of step (a) and amplifying nucleic acid from the sample, thereby isolating or recovering a nucleic acid encoding a polypeptide having an ammonia lyase, e.g., phenylalanine ammonia lyase, tyrosine ammonia lyase and/or histidine ammonia lyase enzyme activity from a sample. One or each member of the amplification primer sequence pair can comprise an oligonucleotide comprising an amplification primer sequence pair of the invention, e.g., having at least about 10 to 50 consecutive bases of a sequence of the invention. In one embodiment of the invention, the sample is an environmental sample.

The invention provides methods for isolating or recovering a nucleic acid encoding a polypeptide having an ammonia lyase, e.g., phenylalanine ammonia lyase, tyrosine ammonia lyase and/or histidine ammonia lyase enzyme activity from a sample, such as an environmental sample, comprising the steps of: (a) providing a polynucleotide probe comprising a nucleic acid of the invention or a subsequence thereof; (b) isolating a nucleic acid from the sample or treating the sample such that nucleic acid in the sample is accessible for hybridization to a polynucleotide probe of step (a); (c) combining the isolated nucleic acid or the treated sample of step (b) with the polynucleotide probe of step (a); and (d) isolating a nucleic acid that specifically hybridizes with the polynucleotide probe of step (a), thereby isolating or recovering a nucleic acid encoding a polypeptide having an ammonia lyase, e.g., phenylalanine ammonia lyase, tyrosine ammonia lyase and/or histidine ammonia lyase enzyme activity from the sample. The sample can comprise an environmental sample, e.g., a water sample, a liquid sample, a soil sample, an air sample or a biological sample. In one aspect, the biological sample can be derived from a bacterial cell, a protozoan cell, an insect cell, a yeast cell, a plant cell, a fungal cell or a mammalian cell. In one embodiment of the invention, the sample is an environmental sample.

The invention provides methods of generating a variant of a nucleic acid encoding a polypeptide having an ammonia lyase, e.g., phenylalanine ammonia lyase, tyrosine ammonia lyase and/or histidine ammonia lyase enzyme activity comprising the steps of: (a) providing a template nucleic acid comprising a nucleic acid of the invention; and (b) modifying, deleting or adding one or more nucleotides in the template sequence, or a combination thereof, to generate a variant of the template nucleic acid. In one aspect, the method can further comprise expressing the variant nucleic acid to generate a variant ammonia lyase, e.g., phenylalanine ammonia lyase, tyrosine ammonia lyase and/or histidine ammonia lyase enzyme polypeptide. The modifications, additions or deletions can be introduced by a method comprising error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, Gene Site Saturation Mutagenesis (GSSM), synthetic ligation reassembly (SLR) or a combination thereof. In another aspect, the modifications, additions or deletions are introduced by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

In one aspect, the method can be iteratively repeated until an ammonia lyase, e.g., phenylalanine ammonia lyase, tyrosine ammonia lyase and/or histidine ammonia lyase enzyme having an altered or different activity or an altered or different stability from that of a polypeptide encoded by the template nucleic acid is produced. In one aspect, the variant ammonia lyase, e.g., phenylalanine ammonia lyase, tyrosine ammonia lyase and/or histidine ammonia lyase enzyme polypeptide is thermotolerant, and retains some activity after being exposed to an elevated temperature. In another aspect, the variant ammonia lyase, e.g., phenylalanine ammonia lyase, tyrosine ammonia lyase and/or histidine ammonia lyase enzyme polypeptide has increased glycosylation as compared to the ammonia lyase, e.g., phenylalanine ammonia lyase, tyrosine ammonia lyase and/or histidine ammonia lyase enzyme encoded by a template nucleic acid. Alternatively, the variant ammonia lyase, e.g., phenylalanine ammonia lyase, tyrosine ammonia lyase and/or histidine ammonia lyase enzyme polypeptide has an ammonia lyase, e.g., phenylalanine ammonia lyase, tyrosine ammonia lyase and/or histidine ammonia lyase enzyme activity under a high temperature, wherein the ammonia lyase, e.g., phenylalanine ammonia lyase, tyrosine ammonia lyase and/or histidine ammonia lyase enzyme encoded by the template nucleic acid is not active under the high temperature. In one aspect, the method can be iteratively repeated until an ammonia lyase, e.g., phenylalanine ammonia lyase, tyrosine ammonia lyase and/or histidine ammonia lyase enzyme coding sequence having an altered codon usage from that of the template nucleic acid is produced. In another aspect, the method can be iteratively repeated until an ammonia lyase, e.g., phenylalanine ammonia lyase, tyrosine ammonia lyase and/or histidine ammonia lyase enzyme gene having higher or lower level of message expression or stability from that of the template nucleic acid is produced.

The invention provides methods for modifying codons in a nucleic acid encoding a polypeptide having an ammonia lyase, e.g., phenylalanine ammonia lyase, tyrosine ammonia lyase and/or histidine ammonia lyase enzyme activity to increase its expression in a host cell, the method comprising the following steps: (a) providing a nucleic acid of the invention encoding a polypeptide having an ammonia lyase, e.g., phenylalanine ammonia lyase, tyrosine ammonia lyase and/or histidine ammonia lyase enzyme activity; and, (b) identifying a non-preferred or a less preferred codon in the nucleic acid of step (a) and replacing it with a preferred or neutrally used codon encoding the same amino acid as the replaced codon, wherein a preferred codon is a codon over-represented in coding sequences in genes in the host cell and a non-preferred or less preferred codon is a codon under-represented in coding sequences in genes in the host cell, thereby modifying the nucleic acid to increase its expression in a host cell.

The invention provides methods for modifying codons in a nucleic acid encoding a polypeptide having an ammonia lyase, e.g., phenylalanine ammonia lyase, tyrosine ammonia lyase and/or histidine ammonia lyase enzyme activity; the method comprising the following steps: (a) providing a nucleic acid of the invention; and, (b) identifying a codon in the nucleic acid of step (a) and replacing it with a different codon encoding the same amino acid as the replaced codon, thereby modifying codons in a nucleic acid encoding an ammonia lyase, e.g., phenylalanine ammonia lyase, tyrosine ammonia lyase and/or histidine ammonia lyase enzyme.

The invention provides methods for modifying codons in a nucleic acid encoding a polypeptide having an ammonia lyase, e.g., phenylalanine ammonia lyase, tyrosine ammonia lyase and/or histidine ammonia lyase enzyme activity to increase its expression in a host cell, the method comprising the following steps: (a) providing a nucleic acid of the invention encoding an ammonia lyase, e.g., phenylalanine ammonia lyase, tyrosine ammonia lyase and/or histidine ammonia lyase enzyme polypeptide; and, (b) identifying a non-preferred or a less preferred codon in the nucleic acid of step (a) and replacing it with a preferred or neutrally used codon encoding the same amino acid as the replaced codon, wherein a preferred codon is a codon over-represented in coding sequences in genes in the host cell and a non-preferred or less preferred codon is a codon under-represented in coding sequences in genes in the host cell, thereby modifying the nucleic acid to increase its expression in a host cell.

The invention provides methods for modifying a codon in a nucleic acid encoding a polypeptide having an ammonia lyase, e.g., phenylalanine ammonia lyase, tyrosine ammonia lyase and/or histidine ammonia lyase enzyme activity to decrease its expression in a host cell, the method comprising the following steps: (a) providing a nucleic acid of the invention; and (b) identifying at least one preferred codon in the nucleic acid of step (a) and replacing it with a non-preferred or less preferred codon encoding the same amino acid as the replaced codon, wherein a preferred codon is a codon over-represented in coding sequences in genes in a host cell and a non-preferred or less preferred codon is a codon under-represented in coding sequences in genes in the host cell, thereby modifying the nucleic acid to decrease its expression in a host cell. In one aspect, the host cell can be a bacterial cell, a fungal cell, an insect cell, a yeast cell, a plant cell or a mammalian cell.

The invention provides methods for producing a library of nucleic acids encoding a plurality of modified ammonia lyase, e.g., phenylalanine ammonia lyase, tyrosine ammonia lyase and/or histidine ammonia lyase enzyme active sites or substrate binding sites, wherein the modified active sites or substrate binding sites are derived from a first nucleic acid comprising a sequence encoding a first active site or a first substrate binding site the method comprising the following steps: (a) providing a first nucleic acid encoding a first active site or first substrate binding site, wherein the first nucleic acid sequence comprises a sequence that hybridizes under stringent conditions to a nucleic acid of the invention, and the nucleic acid encodes an ammonia lyase, e.g., phenylalanine ammonia lyase, tyrosine ammonia lyase and/or histidine ammonia lyase enzyme active site or an ammonia lyase, e.g., phenylalanine ammonia lyase, tyrosine ammonia lyase and/or histidine ammonia lyase enzyme substrate binding site; (b) providing a set of mutagenic oligonucleotides that encode naturally-occurring amino acid variants at a plurality of targeted codons in the first nucleic acid; and, (c) using the set of mutagenic oligonucleotides to generate a set of active site-encoding or substrate binding site-encoding variant nucleic acids encoding a range of amino acid variations at each amino acid codon that was mutagenized, thereby producing a library of nucleic acids encoding a plurality of modified ammonia lyase, e.g., phenylalanine ammonia lyase, tyrosine ammonia lyase and/or histidine ammonia lyase enzyme active sites or substrate binding sites. In one aspect, the method comprises mutagenizing the first nucleic acid of step (a) by a method comprising an optimized directed evolution system, Gene Site Saturation Mutagenesis (GSSM), synthetic ligation reassembly (SLR), error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, and a combination thereof. In another aspect, the method comprises mutagenizing the first nucleic acid of step (a) or variants by a method comprising recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation and a combination thereof.

The invention provides methods for making a small molecule comprising the following steps: (a) providing a plurality of biosynthetic enzymes capable of synthesizing or modifying a small molecule, wherein one of the enzymes comprises an ammonia lyase, e.g., phenylalanine ammonia lyase, tyrosine ammonia lyase and/or histidine ammonia lyase enzyme encoded by a nucleic acid of the invention; (b) providing a substrate for at least one of the enzymes of step (a); and (c) reacting the substrate of step (b) with the enzymes under conditions that facilitate a plurality of biocatalytic reactions to generate a small molecule by a series of biocatalytic reactions. The invention provides methods for modifying a small molecule comprising the following steps: (a) providing an ammonia lyase, e.g., phenylalanine ammonia lyase, tyrosine ammonia lyase and/or histidine ammonia lyase enzyme, wherein the enzyme comprises a polypeptide of the invention, or, a polypeptide encoded by a nucleic acid of the invention, or a subsequence thereof; (b) providing a small molecule; and (c) reacting the enzyme of step (a) with the small molecule of step (b) under conditions that facilitate an enzymatic reaction catalyzed by the ammonia lyase, e.g., phenylalanine ammonia lyase, tyrosine ammonia lyase and/or histidine ammonia lyase enzyme, thereby modifying a small molecule by an ammonia lyase, e.g., phenylalanine ammonia lyase, tyrosine ammonia lyase and/or histidine ammonia lyase enzymatic reaction. In one aspect, the method can comprise a plurality of small molecule substrates for the enzyme of step (a), thereby generating a library of modified small molecules produced by at least one enzymatic reaction catalyzed by the ammonia lyase, e.g., phenylalanine ammonia lyase, tyrosine ammonia lyase and/or histidine ammonia lyase enzyme. In one aspect, the method can comprise a plurality of additional enzymes under conditions that facilitate a plurality of biocatalytic reactions by the enzymes to form a library of modified small molecules produced by the plurality of enzymatic reactions. In another aspect, the method can further comprise the step of testing the library to determine if a particular modified small molecule that exhibits a desired activity is present within the library. The step of testing the library can further comprise the steps of systematically eliminating all but one of the biocatalytic reactions used to produce a portion of the plurality of the modified small molecules within the library by testing the portion of the modified small molecule for the presence or absence of the particular modified small molecule with a desired activity, and identifying at least one specific biocatalytic reaction that produces the particular modified small molecule of desired activity.

The invention provides methods for determining a functional fragment of an ammonia lyase, e.g., phenylalanine ammonia lyase, tyrosine ammonia lyase and/or histidine ammonia lyase enzyme comprising the steps of: (a) providing an ammonia lyase, e.g., phenylalanine ammonia lyase, tyrosine ammonia lyase and/or histidine ammonia lyase enzyme, wherein the enzyme comprises a polypeptide of the invention, or a polypeptide encoded by a nucleic acid of the invention, or a subsequence thereof; and (b) deleting a plurality of amino acid residues from the sequence of step (a) and testing the remaining subsequence for an ammonia lyase, e.g., phenylalanine ammonia lyase, tyrosine ammonia lyase and/or histidine ammonia lyase enzyme activity, thereby determining a functional fragment of an ammonia lyase, e.g., phenylalanine ammonia lyase, tyrosine ammonia lyase and/or histidine ammonia lyase enzyme. In one aspect, the ammonia lyase, e.g., phenylalanine ammonia lyase, tyrosine ammonia lyase and/or histidine ammonia lyase enzyme activity is measured by providing an ammonia lyase, e.g., phenylalanine ammonia lyase, tyrosine ammonia lyase and/or histidine ammonia lyase enzyme substrate and detecting a decrease in the amount of the substrate or an increase in the amount of a reaction product.

The invention provides methods for whole cell engineering of new or modified phenotypes by using real-time metabolic flux analysis, the method comprising the following steps: (a) making a modified cell by modifying the genetic composition of a cell, wherein the genetic composition is modified by addition to the cell of a nucleic acid of the invention; (b) culturing the modified cell to generate a plurality of modified cells; (c) measuring at least one metabolic parameter of the cell by monitoring the cell culture of step (b) in real time; and, (d) analyzing the data of step (c) to determine if the measured parameter differs from a comparable measurement in an unmodified cell under similar conditions, thereby identifying an engineered phenotype in the cell using real-time metabolic flux analysis. In one aspect, the genetic composition of the cell can be modified by a method comprising deletion of a sequence or modification of a sequence in the cell, or, knocking out the expression of a gene. In one aspect, the method can further comprise selecting a cell comprising a newly engineered phenotype. In another aspect, the method can comprise culturing the selected cell, thereby generating a new cell strain comprising a newly engineered phenotype.

The invention provides methods of increasing thermotolerance or thermostability of an ammonia lyase, e.g., phenylalanine ammonia lyase, tyrosine ammonia lyase and/or histidine ammonia lyase enzyme polypeptide, the method comprising glycosylating an ammonia lyase, e.g., phenylalanine ammonia lyase, tyrosine ammonia lyase and/or histidine ammonia lyase enzyme polypeptide, wherein the polypeptide comprises at least thirty contiguous amino acids of a polypeptide of the invention; or a polypeptide encoded by a nucleic acid sequence of the invention, thereby increasing the thermotolerance or thermostability of the ammonia lyase, e.g., phenylalanine ammonia lyase, tyrosine ammonia lyase and/or histidine ammonia lyase polypeptide. In one aspect, the ammonia lyase, e.g., phenylalanine ammonia lyase, tyrosine ammonia lyase and/or histidine ammonia lyase enzyme specific activity can be thermostable or thermotolerant at a temperature in the range from greater than about 37° C. to about 95° C.

The invention provides methods for overexpressing a recombinant ammonia lyase, e.g., phenylalanine ammonia lyase, tyrosine ammonia lyase and/or histidine ammonia lyase polypeptide in a cell comprising expressing a vector comprising a nucleic acid comprising a nucleic acid of the invention or a nucleic acid sequence of the invention, wherein the sequence identities are determined by analysis with a sequence comparison algorithm or by visual inspection, wherein overexpression is effected by use of a high activity promoter, a dicistronic vector or by gene amplification of the vector.

The invention provides methods of making a transgenic plant comprising the following steps: (a) introducing a heterologous nucleic acid sequence into the cell, wherein the heterologous nucleic sequence comprises a nucleic acid sequence of the invention, thereby producing a transformed plant cell; and (b) producing a transgenic plant from the transformed cell. In one aspect, the step (a) can further comprise introducing the heterologous nucleic acid sequence by electroporation or microinjection of plant cell protoplasts. In another aspect, the step (a) can further comprise introducing the heterologous nucleic acid sequence directly to plant tissue by DNA particle bombardment. Alternatively, the step (a) can further comprise introducing the heterologous nucleic acid sequence into the plant cell DNA using an *Agrobacterium tumefaciens* host. In one aspect, the plant cell can be a potato, corn, rice, wheat, tobacco, or barley cell.

The invention provides methods of expressing a heterologous nucleic acid sequence in a plant cell comprising the following steps: (a) transforming the plant cell with a heterologous nucleic acid sequence operably linked to a promoter, wherein the heterologous nucleic sequence comprises a nucleic acid of the invention; (b) growing the plant under conditions wherein the heterologous nucleic acids sequence is expressed in the plant cell. The invention provides methods of expressing a heterologous nucleic acid sequence in a plant cell comprising the following steps: (a) transforming the plant cell with a heterologous nucleic acid sequence operably linked to a promoter, wherein the heterologous nucleic sequence comprises a sequence of the invention; (b) growing the plant under conditions wherein the heterologous nucleic acids sequence is expressed in the plant cell.

The invention provides feeds or foods comprising a polypeptide of the invention, or a polypeptide encoded by a nucleic acid of the invention. In one aspect, the invention provides a food, feed, a liquid, e.g., a beverage (such as a fruit juice or a beer), a bread or a dough or a bread product, or a beverage precursor (e.g., a wort), comprising a polypeptide of the invention. The invention provides food or nutritional supplements for an animal comprising a polypeptide of the invention, e.g., a polypeptide encoded by the nucleic acid of the invention.

In one aspect, the polypeptide in the food or nutritional supplement can be glycosylated. The invention provides edible enzyme delivery matrices comprising a polypeptide of the invention, e.g., a polypeptide encoded by the nucleic acid of the invention. In one aspect, the delivery matrix comprises a pellet. In one aspect, the polypeptide can be glycosylated. In one aspect, the ammonia lyase, e.g., phenylalanine ammonia lyase, tyrosine ammonia lyase and/or histidine ammonia lyase enzyme activity is thermotolerant. In another aspect, the ammonia lyase, e.g., phenylalanine ammonia lyase, tyrosine ammonia lyase and/or histidine ammonia lyase enzyme activity is thermostable.

The invention provides a food, a feed or a nutritional supplement comprising a polypeptide of the invention. The invention provides methods for utilizing an ammonia lyase, e.g., phenylalanine ammonia lyase, tyrosine ammonia lyase and/or histidine ammonia lyase enzyme as a nutritional supplement in an animal diet, the method comprising: preparing a nutritional supplement containing an ammonia lyase, e.g., phenylalanine ammonia lyase, tyrosine ammonia lyase and/or histidine ammonia lyase enzyme comprising at least thirty contiguous amino acids of a polypeptide of the invention; and administering the nutritional supplement to an animal. The animal can be a human, a ruminant or a monogastric animal. The ammonia lyase, e.g., phenylalanine ammonia lyase, tyrosine ammonia lyase and/or histidine ammonia lyase enzyme can be prepared by expression of a polynucleotide encoding the ammonia lyase, e.g., phenylalanine ammonia lyase, tyrosine ammonia lyase and/or histidine ammonia lyase enzyme in an organism selected from the group consisting of a bacterium, a yeast, a plant, an insect, a fungus and an animal. The organism can be selected from the group consisting of an *S. pombe, S. cerevisiae, Pichia pastoris, E. coli, Streptomyces* sp., *Bacillus* sp. and *Lactobacillus* sp.

The invention provides edible enzyme delivery matrix comprising a thermostable recombinant ammonia lyase, e.g., phenylalanine ammonia lyase, tyrosine ammonia lyase and/or histidine ammonia lyase enzyme, e.g., a polypeptide of the invention. The invention provides methods for delivering an ammonia lyase, e.g., phenylalanine ammonia lyase, tyrosine ammonia lyase and/or histidine ammonia lyase enzyme supplement to an animal, the method comprising: preparing an edible enzyme delivery matrix in the form of pellets comprising a granulate edible carrier and a thermostable recombinant ammonia lyase, e.g., phenylalanine ammonia lyase, tyrosine ammonia lyase and/or histidine ammonia lyase enzyme, wherein the pellets readily disperse the ammonia lyase, e.g., phenylalanine ammonia lyase, tyrosine ammonia lyase and/or histidine ammonia lyase enzyme contained therein into aqueous media, and administering the edible enzyme delivery matrix to the animal. The recombinant ammonia lyase, e.g., phenylalanine ammonia lyase, tyrosine ammonia lyase and/or histidine ammonia lyase enzyme can comprise a polypeptide of the invention. The ammonia lyase, e.g., phenylalanine ammonia lyase, tyrosine ammonia lyase and/or histidine ammonia lyase enzyme can be glycosylated to provide thermostability at pelletizing conditions. The delivery matrix can be formed by pelletizing a mixture comprising a grain germ and an ammonia lyase, e.g., phenylalanine ammonia lyase, tyrosine ammonia lyase and/or histidine ammonia lyase enzyme. The pelletizing conditions can include application of steam. The pelletizing conditions can comprise application of a temperature in excess of about 80° C. for about 5 minutes and the enzyme retains a specific activity of at least 350 to about 900 units per milligram of enzyme.

In certain aspects, a histidine-, phenylalanine- or tyrosine-containing compound is contacted a polypeptide of the invention having an ammonia lyase, e.g., phenylalanine ammonia lyase, tyrosine ammonia lyase and/or histidine ammonia lyase enzyme activity at a pH in the range of between about pH 3.0 to 9.0, 10.0, 11.0 or more. In other aspects, a histidine-, phenylalanine- or tyrosine-containing compound is contacted with the ammonia lyase, e.g., phenylalanine ammonia lyase, tyrosine ammonia lyase and/or histidine ammonia lyase enzyme at a temperature of about 55° C., 60° C., 65° C., 70° C., 75° C., 80° C., 85° C., 90° C., or more.

In one aspect, invention provides a pharmaceutical composition comprising an ammonia lyase, e.g., phenylalanine ammonia lyase, tyrosine ammonia lyase and/or histidine ammonia lyase enzyme of the invention, or a polypeptide encoded by a nucleic acid of the invention. In one aspect, the pharmaceutical composition acts as a digestive aid. The lyase can be formulated as a tablet, gel, geltab, pill, implant, liquid, spray, powder, food, feed pellet, as an injectable formulation or as an encapsulated formulation. In one aspect, the polypeptide has ammonia lyase activity, or phenylalanine ammonia lyase activity, tyrosine ammonia lyase activity and/or histidine ammonia lyase activity. The pharmaceutical composition or dietary supplement can be formulated for the treatment (amelioration) of phenylketonuria (PKU).

The polypeptide in the pharmaceutical composition or dietary supplement can be chemically modified to produce a protected form that possesses better specific activity, prolonged half-life, and/or reduced immunogenicity in vivo, e.g., the polypeptide can be chemically modified by glycosylation, pegylation (modified with polyethylene glycol (PEG), activated PEG, or equivalent), encapsulation with liposomes or equivalent, encapsulated in nanostructures (e.g., nanotubules, nano- or microcapsules), or combinations thereof, or equivalents thereof, e.g., as described by Wang (2005) Mol Genet Metab. 86(1-2):134-140. Epub 2005 M il. In one aspect, the polypeptide is chemically conjugated with activated PEG, or, 2,4-bis(O-methoxypolyethyleneglycol)-6-chloro-s-triazine, e.g., as described by Ikeda (2005) Amino Acids 29(3):283-287. Epub Jun. 28, 2005.

The invention also provides biocompatible matrices such as sol-gels encapsulating a polypeptide of the invention for use as pharmaceutical composition or dietary supplement, e.g., to treat or ameliorate phenylketonuria (PKU), e.g., including silica-based (e.g., oxysilane) sol-gel matrices. The invention also provides nano- or microcapsules comprising a polypeptide of the invention for use as pharmaceutical composition or dietary supplement, e.g., to treat or ameliorate phenylketonuria (PKU).

The invention also provides matrix stabilized enzyme crystals comprising a polypeptide of the invention for use as pharmaceutical composition or dietary supplement, e.g., to treat or ameliorate phenylketonuria (PKU), e.g., as described in U.S. Patent App. No. 20020182201; for example, the formulation can be a cross-linked crystalline enzyme and a polymer with a reactive moiety effective to adhere to the crystal layer of the crystalline enzyme. The invention also provides polypeptides of the invention as polymers in the form of multimerized (e.g., multi-functional) cross-linking forms; which in one aspect comprise a matrix stabilized enzyme crystal, e.g., a form resistant to degradation by proteolytic enzymes; and in alternative aspects, the cross-linking reagents comprise a dialdehyde cross-linking reagents, as discussed in detail, below.

The details of one or more aspects of the invention are set forth in the accompanying drawings and the description below. Other features, objects, and advantages of the invention will be apparent from the description and drawings, and from the claims.

All publications, patents, patent applications, GenBank sequences and ATCC deposits, cited herein are hereby expressly incorporated by reference for all purposes.

BRIEF DESCRIPTION OF DRAWINGS

The following drawings are illustrative of aspects of the invention and are not meant to limit the scope of the invention as encompassed by the claims.

FIG. 8 is a Table 1, which sets forth exemplary functions and other information regarding exemplary sequences of the invention, as discussed in detail, below.

FIG. 9 is a Table 1, which sets forth exemplary functions (demonstrated to be active on o-Bromo Phe) and other information regarding exemplary PALs of the invention, as summarized in Table 2, as discussed in detail in Example 5, below.

Like reference symbols in the various drawings indicate like elements.

DETAILED DESCRIPTION

Figure 1:
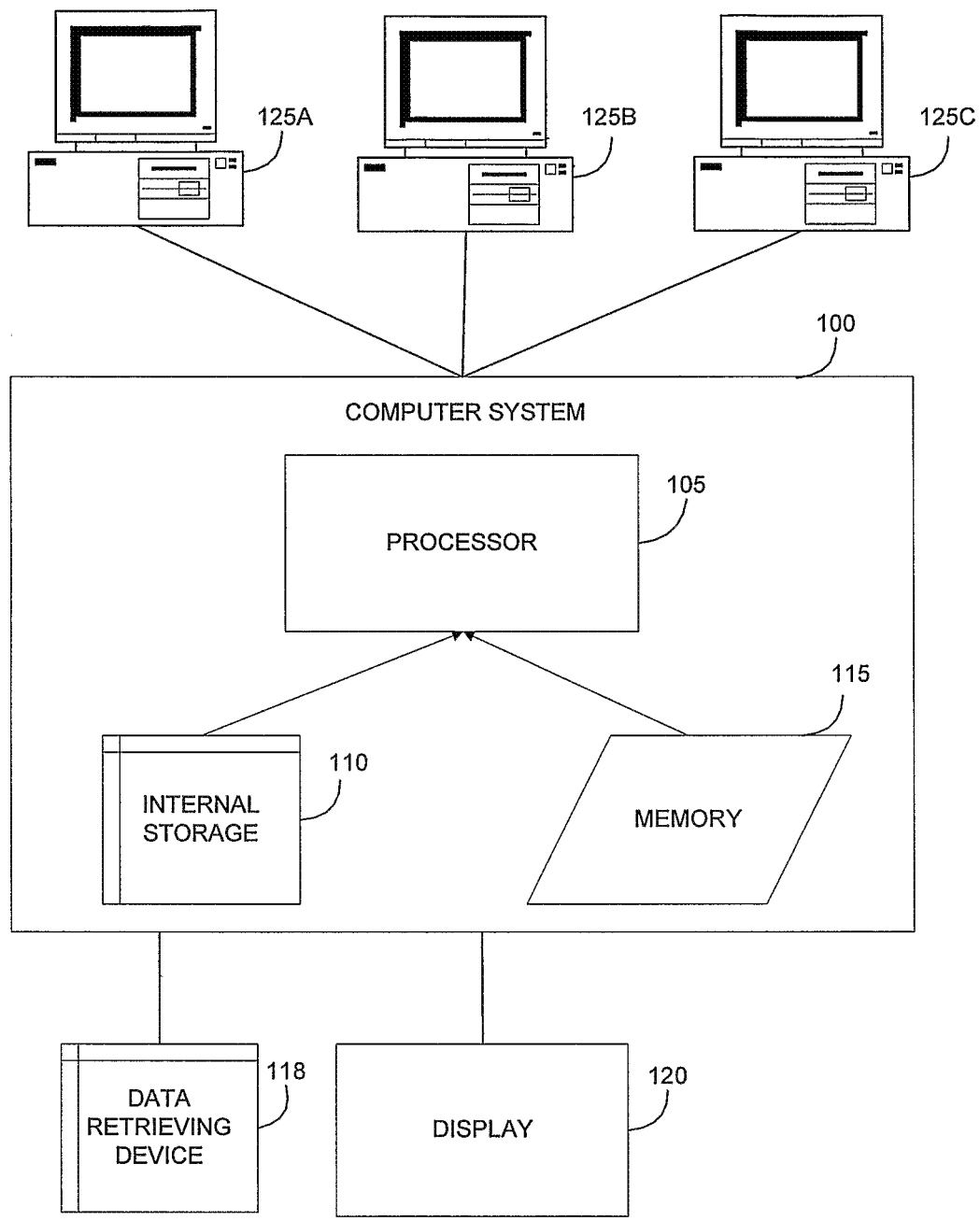
FIG. 1 is a block diagram of a computer system.

The invention provides polypeptides and peptides having at least one ammonia lyase activity, e.g., at least one phenylalanine ammonia lyase (PAL), tyrosine ammonia lyase (TAL) and/or histidine ammonia lyase (HAL) activity, and polynucleotides encoding them, and methods of making and using these polynucleotides and polypeptides. The invention also provides ammonia lyase enzymes, e.g., phenylalanine ammonia lyase (PAL), tyrosine ammonia lyase (TAL) and histidine ammonia lyase (HAL) enzymes, polynucleotides encoding these enzymes, the use of such polynucleotides and polypeptides.

A number of aspects have been described above and are described in more detail infra. The embodiments of the invention include one or more of the described aspects.

The following explanations of terms and methods are provided to better describe the present disclosure and to guide those of ordinary skill in the art in the practice of the present disclosure. As used herein, "including" means "comprising." In addition, the singular forms "a" or "an" or "the" include plural references unless the context clearly dictates otherwise. For example, reference to "comprising a protein" includes one or a plurality of such proteins, and reference to "comprising the cell" includes reference to one or more cells and equivalents thereof known to those skilled in the art, and so forth. The term "about" encompasses the range of experimental error that occurs in any measurement. Unless otherwise stated, all measurement numbers are presumed to have the word "about" in front of them even if the word "about" is not expressly used.

The invention provides novel phenylalanine ammonia lyase, tyrosine ammonia lyase and histidine ammonia lyase enzymes. The invention also provides novel activity assignment for several previously described putative histidine ammonia lyases (HALs). Specifically, these putative HALs either have no HAL activity, but have phenylalanine ammonia lyase (PAL) and/or TAL activity or these putative HALs additionally have PAL and/or tyrosine ammonia lyase (TAL) activity.

Table 1, presented as FIG. 8, details an exemplary activity determined for each exemplary polypeptide of the invention (and, also notes one exemplary nucleic acid of the invention that encodes the exemplary polypeptide; as determined by the assays described in Examples 1, 2 and 3, below. Table 1 also sets forth the source organism from which the polynucleotide was isolated (where "unknown" means that the source was an environmental sample), the GenBank accession number of the top BLAST hit, the organism from which the top BLAST hit was isolated, the percent sequence identity between the polypeptide of the invention and the top BLAST hit, the activity assigned to the top BLAST hit, and notes for that particular polynucleotide/polypeptide entry. For example, as an aid in reading the table, the polypeptide SEQ ID NO:2, encoded, e.g., by SEQ ID NO:1, has TAL and PAL activity, was initially isolated from *Tannerella forsythensis* ATCC 43037, in sequence comparison analysis, the top hit was gn1|TIGR_203275|contig:5077; or, reading further down the table: the polypeptide SEQ ID NO:236, encoded, e.g., by SEQ ID NO:235, has at least an esterase activity, was initially isolated from *Pseudomonasfluorescens* PfO-I, the top hit (closest match in comparing sequences) in sequence comparison analysis (see above) was the hypothetical protein [*Nostoc punctiforme*], Genbank accession no. 23123897, which had 54% sequence identity to SEQ ID NO:236.

Figure 5:
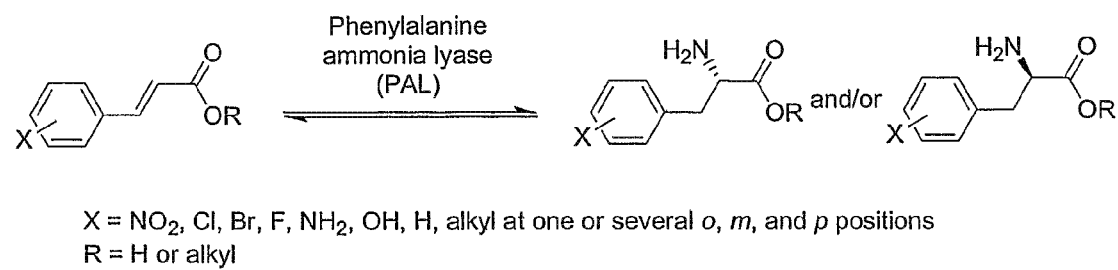
FIG. 5 is an illustration of an exemplary reaction catalyzed by exemplary phenylalanine ammonia lyases (PALs) of the invention, wherein phenylalanine is deaminated to trans-cinnamic acid and ammonia.
Figure 6A:
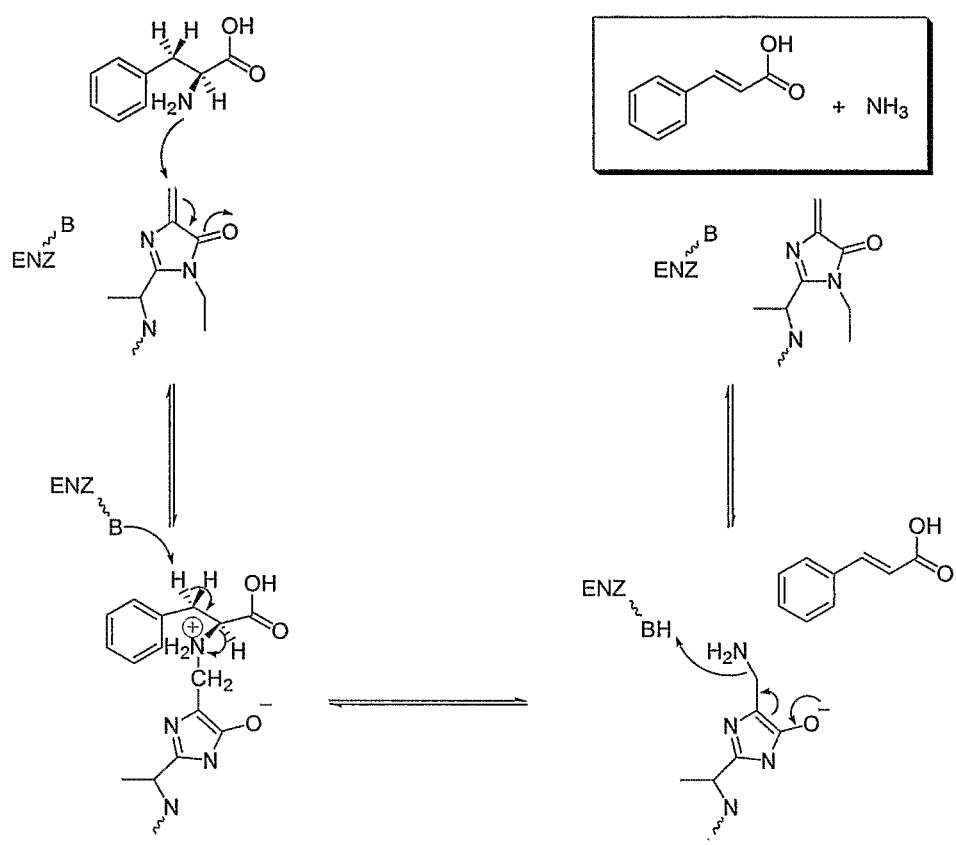
FIGS. 6A and 6B illustrate exemplary catalytic mechanisms of phenylalanine ammonia lyases (PALs).
Figure 6B:
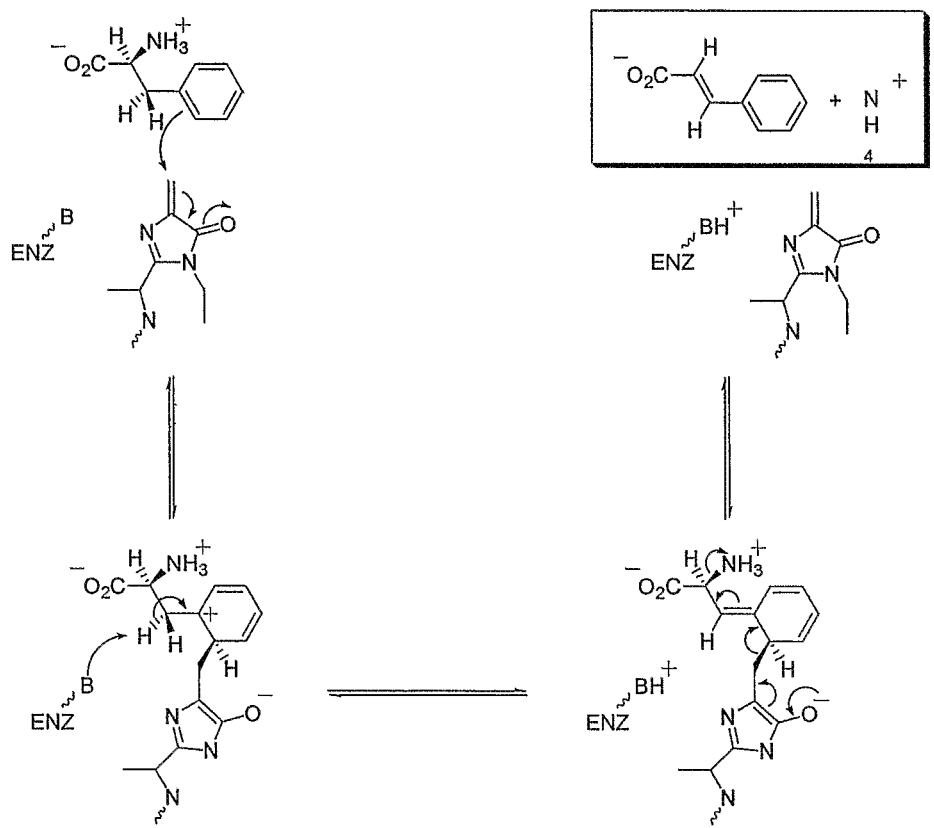
Figure 7:
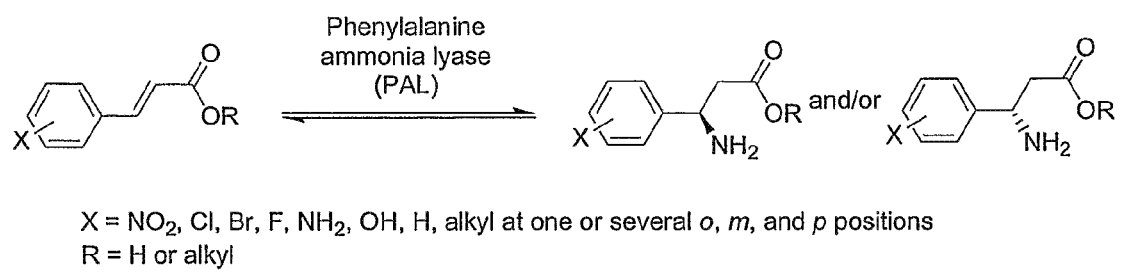
FIG. 7 is an illustration of an exemplary reaction of the invention, wherein β-Amino Acids are synthesized by phenylalanine ammonia lyases, or PALs, of the invention.

In one aspect, the invention provides methods for the synthesis or manufacture of L- and D-phenylalanine and L- and D-tyrosine as well as L- and D-phenylalanine and L- and D-tyrosine derivatives (see FIG. 5). In another aspect, the invention provides methods for the synthesis or manufacture of cinnamic acid and cinnamic acid derivatives. In yet another aspect, the invention provides methods for the synthesis or manufacture of para-hydroxycinnamic acid and para-hydroxyl styrene via biocatalytic and fermentation. In another aspect, the invention provides methods for the synthesis or manufacture of ortho-bromo and ortho-chloro L-phenylalanine and of ortho-bromo and ortho-chloro D-phenylalanine, as well as derivatives thereof. In yet another aspect, the invention provides methods for the synthesis or manufacture of L- and D-β-amino acids (see FIGS. 6a and 6b) and L- and D-histidine and derivatives. In another aspect, the invention provides methods for the synthesis or manufacture of urocanoic acid and urocanoic acid derivatives, from histidine and histidine derivatives.

In further aspects, the invention provides methods for the manufacture of bulk and fine chemicals for industrial, medicinal and agricultural use, using the enzymes of the invention. In other aspects, the invention provides methods of application of the enzymes of the invention for enzyme substitution therapy, e.g., using PALs for the treatment of phenylketonuria (PKU), an inherited metabolic disease caused by a deficiency of the enzyme phenylalanine hydroxylase.

In one aspect the invention provides compositions (e.g., feeds, drugs, dietary supplements) comprising the enzymes, polypeptides or polynucleotides of the invention. These compositions can be formulated in a variety of forms, e.g., as liquids, sprays, films, micelles, liposomes, powders, food, feed pellets or encapsulated forms, including encapsulated forms.

Assays for measuring ammonia lyase activity, e.g., phenylalanine ammonia lyase, tyrosine ammonia lyase and/or histidine ammonia lyase activity, e.g., for determining if a polypeptide has lyase activity, e.g., phenylalanine ammonia lyase, tyrosine ammonia lyase and/or histidine ammonia lyase activity, are well known in the art and are within the scope of the invention; see, e.g., the PAL enzyme activity assay described in Baedeker & Schulz (Eur. J. Biochem 2002, 269, 1790-1797), the PAL enzyme activity assay described in Rother & Retey (Eur. J. Biochem, 2002, 269, 3065-3075), the PAL enzyme activity assay described in Kyndt et al. (FEBS Letters 2002, 512, 240-24), or the TAL enzyme activity assay described in Kyndt et al. (FEBS Letters 2002, 512, 240-24).

The pH of reaction conditions utilized by the invention is another variable parameter for which the invention provides. In certain aspects, the pH of the reaction is conducted in the range of about 3.0 to about 9.0. In other aspects, the pH is about 4.5 or the pH is about 7.5 or the pH is about 9. Reaction conditions conducted under alkaline conditions are particularly advantageous.

The invention provides for ammonia lyase, e.g., phenylalanine ammonia lyase, tyrosine ammonia lyase and/or histidine ammonia lyase polypeptides of the invention in a variety of forms and formulations. In the methods of the invention, ammonia lyase, e.g., phenylalanine ammonia lyase, tyrosine ammonia lyase and/or histidine ammonia lyase polypeptides of the invention are used in a variety of forms and formulations. For example, purified ammonia lyase, e.g., phenylalanine ammonia lyase, tyrosine ammonia lyase and/or histidine ammonia lyase polypeptides can be used in enzyme substitution therapy, e.g., using PALs for the treatment of phenylketonuria (PKU), an inherited metabolic disease caused by a deficiency of the enzyme phenylalanine hydroxylase.

Alternatively, the ammonia lyase, e.g., phenylalanine ammonia lyase, tyrosine ammonia lyase and/or histidine ammonia lyase polypeptide can be expressed in a microorganism using procedures known in the art. In other aspects, the ammonia lyase, e.g., phenylalanine ammonia lyase, tyrosine ammonia lyase and/or histidine ammonia lyase polypeptides of the invention can be immobilized on a solid support prior to use in the methods of the invention. Methods for immobilizing enzymes on solid supports are commonly known in the art, for example J. Mol. Cat. B: Enzymatic 6 (1999) 29-39; Chivata et al. Biocatalysis: Immobilized cells and enzymes, J Mol. Cat. 37 (1986) 1-24: Sharma et al., Immobilized Biomaterials Techniques and Applications, Angew. Chem. Int. Ed. Engl. 21 (1982) 837-54: Laskin (Ed.), Enzymes and Immobilized Cells in Biotechnology.

Nucleic Acids

In one aspect, the invention provides isolated, recombinant and synthetic nucleic acids having a sequence identity to an exemplary sequence of the invention (e.g., any of the odd numbered SEQ ID NO: s between SEQ ID NO:1 and SEQ ID NO:251; nucleic acids encoding polypeptides of the invention, e.g., exemplary polypeptides of the invention, including all even numbered SEQ ID NO: s between SEQ ID NO:2 and SEQ ID NO:252) including expression cassettes such as expression vectors, encoding the polypeptides of the invention. The invention also includes methods for discovering new ammonia lyase, e.g., phenylalanine ammonia lyase, tyrosine ammonia lyase and/or histidine ammonia lyase polypeptide sequences using the nucleic acids of the invention. The invention also includes methods for inhibiting the expression of ammonia lyase, e.g., phenylalanine ammonia lyase, tyrosine ammonia lyase and/or histidine ammonia lyase enzyme genes, transcripts and polypeptides using the nucleic acids of the invention. Also provided are methods for modifying the nucleic acids of the invention by, e.g., synthetic ligation reassembly, optimized directed evolution system and/or saturation mutagenesis.

The nucleic acids of the invention can be made, isolated and/or manipulated by, e.g., cloning and expression of cDNA libraries, amplification of message or genomic DNA by PCR, and the like. For example, exemplary sequences of the invention were initially derived from environmental sources. Regarding the term "derived" for purposes of the specification and claims, in some aspects, a substance is "derived" from an organism or source if any one or more of the following are true: 1) the substance is present in the organism/source; 2) the substance is removed from the native host; or, 3) the substance is removed from the native host and is evolved, for example, by mutagenesis.

The phrases "nucleic acid" or "nucleic acid sequence" as used herein refer to an oligonucleotide, nucleotide, polynucleotide, or to a fragment of any of these, to DNA or RNA of genomic or synthetic origin which may be single-stranded or double-stranded and may represent a sense or antisense (complementary) strand, to peptide nucleic acid (PNA), or to any DNA-like or RNA-like material, natural or synthetic in origin. The phrases "nucleic acid" or "nucleic acid sequence" includes oligonucleotide, nucleotide, polynucleotide, or to a fragment of any of these, to DNA or RNA (e.g., mRNA, rRNA, tRNA, iRNA) of genomic or synthetic origin which may be single-stranded or double-stranded and may represent a sense or antisense strand, to peptide nucleic acid (PNA), or to any DNA-like or RNA-like material, natural or synthetic in origin, including, e.g., iRNA, ribonucleoproteins (e.g., e.g., double stranded iRNAs, e.g., iRNPs). The term encompasses nucleic acids, i.e., oligonucleotides, containing known analogues of natural nucleotides. The term also encompasses nucleic-acid-like structures with synthetic backbones, see e.g., Mata (1997) Toxicol. Appl. Pharmacol. 144:189-197; Strauss-Soukup (1997) Biochemistry 36:8692-8698; Samstag (1996) Antisense Nucleic Acid Drug Dev 6:153-156. "Oligonucleotide" includes either a single stranded polydeoxynucleotide or two complementary polydeoxynucleotide strands which may be chemically synthesized. Such synthetic oligonucleotides have no 5' phosphate and thus will not ligate to another oligonucleotide without adding a phosphate with an ATP in the presence of a kinase. A synthetic oligonucleotide can ligate to a fragment that has not been dephosphorylated.

A "coding sequence of or a "nucleotide sequence encoding" a particular polypeptide or protein, is a nucleic acid sequence which is transcribed and translated into a polypeptide or protein when placed under the control of appropriate regulatory sequences. The term "gene" means the segment of DNA involved in producing a polypeptide chain; it includes regions preceding and following the coding region (leader and trailer) as well as, where applicable, intervening sequences (introns) between individual coding segments (exons). "Operably linked" as used herein refers to a functional relationship between two or more nucleic acid (e.g., DNA) segments. Typically, it refers to the functional relationship of transcriptional regulatory sequence to a transcribed sequence. For example, a promoter is operably linked to a coding sequence, such as a nucleic acid of the invention, if it stimulates or modulates the transcription of the coding sequence in an appropriate host cell or other expression system. Generally, promoter transcriptional regulatory sequences that are operably linked to a transcribed sequence are physically contiguous to the transcribed sequence, i.e., they are cis-acting. However, some transcriptional regulatory sequences, such as enhancers, need not be physically contiguous or located in close proximity to the coding sequences whose transcription they enhance.

In one aspect, the invention provides ammonia lyase, e.g., phenylalanine ammonia lyase, tyrosine ammonia lyase and/or histidine ammonia lyase enzyme-encoding nucleic acids, and the polypeptides encoded by them, with a common novelty in that they are derived from a common source, e.g., an environmental or a bacterial source. In practicing the methods of the invention, homologous genes can be modified by manipulating a template nucleic acid, as described herein. The invention can be practiced in conjunction with any method or protocol or device known in the art, which are well described in the scientific and patent literature.

One aspect of the invention is an isolated nucleic acid comprising one of the sequences of the invention, or a fragment comprising at least 10, 15, 20, 25, 30, 35, 40, 50, 75, 100, 150, 200, 300, 400, or 500 or more consecutive bases of a nucleic acid of the invention. The isolated, nucleic acids may comprise DNA, including cDNA, genomic DNA and synthetic DNA. The DNA may be double-stranded or single-stranded and if single stranded may be the coding strand or non-coding (anti-sense) strand. Alternatively, the isolated nucleic acids may comprise RNA.

The isolated nucleic acids of the invention may be used to prepare one of the polypeptides of the invention, or fragments comprising at least 5, 10, 15, 20, 25, 30, 35, 40, 50, 75, 100, or 150 or more consecutive amino acids of one of the polypeptides of the invention. Accordingly, another aspect of the invention is an isolated nucleic acid which encodes one of the polypeptides of the invention, or fragments comprising at least 5, 10, 15, 20, 25, 30, 35, 40, 50, 75, 100, or 150 or more consecutive amino acids of one of the polypeptides of the invention. The coding sequences of these nucleic acids may be identical to one of the coding sequences of one of the nucleic acids of the invention or may be different coding sequences which encode one of the of the invention having at least 5, 10, 15, 20, 25, 30, 35, 40, 50, 75, 100, or 150 or more consecutive amino acids of one of the polypeptides of the invention, as a result of the redundancy or degeneracy of the genetic code. The genetic code is well known to those of skill in the art and can be obtained, e.g., on page 214 of B. Lewin, Genes VI, Oxford University Press, 1997.

The isolated nucleic acid which encodes one of the polypeptides of the invention, but is not limited to: only the coding sequence of a nucleic acid of the invention and additional coding sequences, such as leader sequences or proprotein sequences and non-coding sequences, such as introns or non-coding sequences 5' and/or 3' of the coding sequence. Thus, as used herein, the term "polynucleotide encoding a polypeptide" encompasses a polynucleotide which includes only the coding sequence for the polypeptide as well as a polynucleotide which includes additional coding and/or non-coding sequence.

Alternatively, the nucleic acid sequences of the invention, may be mutagenized using conventional techniques, such as site directed mutagenesis, or other techniques familiar to those skilled in the art, to introduce silent changes into the polynucleotides o of the invention. As used herein, "silent changes" include, for example, changes which do not alter the amino acid sequence encoded by the polynucleotide. Such changes may be desirable in order to increase the level of the polypeptide produced by host cells containing a vector encoding the polypeptide by introducing codons or codon pairs which occur frequently in the host organism.

The invention also relates to polynucleotides which have nucleotide changes which result in amino acid substitutions, additions, deletions, fusions and truncations in the polypeptides of the invention. Such nucleotide changes may be introduced using techniques such as site directed mutagenesis, random chemical mutagenesis, exonuclease III deletion and other recombinant DNA techniques. Alternatively, such nucleotide changes may be naturally occurring allelic variants which are isolated by identifying nucleic acids which specifically hybridize to probes comprising at least 10, 15, 20, 25, 30, 35, 40, 50, 75, 100, 150, 200, 300, 400, or 500 consecutive bases of one of the sequences of the invention (or the sequences complementary thereto) under conditions of high, moderate, or low stringency as provided herein.

The term "variant" refers to polynucleotides or polypeptides of the invention modified at one or more base pairs, codons, introns, exons, or amino acid residues (respectively) yet still retain the biological activity of an ammonia lyase, e.g., phenylalanine ammonia lyase, tyrosine ammonia lyase and/or histidine ammonia lyase of the invention. Variants can be produced by any number of means included methods such as, for example, error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, GSSM and any combination thereof.

General Techniques and Terms

The nucleic acids used to practice this invention, whether RNA, siRNA, miRNA, antisense nucleic acid, cDNA, genomic DNA, vectors, viruses or hybrids thereof, may be isolated from a variety of sources, genetically engineered, amplified, and/or expressed/generated recombinantly. Recombinant polypeptides (e.g., ammonia lyase, e.g., phenylalanine ammonia lyase, tyrosine ammonia lyase and/or histidine ammonia lyase enzymes) generated from these nucleic acids can be individually isolated or cloned and tested for a desired activity.

Any recombinant expression system can be used, including bacterial, mammalian, fungal, yeast, insect or plant cell expression systems. "Recombinant" polypeptides or proteins refer to polypeptides or proteins produced by recombinant DNA techniques; i.e., produced from cells transformed by an exogenous DNA construct encoding the desired polypeptide or protein. "Synthetic" polypeptides or protein are those prepared by chemical synthesis. Solid-phase chemical peptide synthesis methods can also be used to synthesize the polypeptide or fragments of the invention. Such method have been known in the art since the early 1960's (Merrifield, R. B., *J. Am. Chem. Soc,* 0.85:2149-2154, 1963) (See also Stewart, J. M. and Young, J. D., Solid Phase Peptide Synthesis, 2nd Ed., Pierce Chemical Co., Rockford, 111., pp. 11-12)) and have recently been employed in commercially available laboratory peptide design and synthesis kits (Cambridge Research Biochemicals). Such commercially available laboratory kits have generally utilized the teachings of H. M. Geysen et al, *Proc. Natl. Acad. ScL, USA,* 81:3998 (1984) and provide for synthesizing peptides upon the tips of a multitude of "rods" or "pins" all of which are connected to a single plate. Additionally, as used herein, the term "recombinant" means that the nucleic acid is adjacent to a "backbone" nucleic acid to which it is not adjacent in its natural environment.

Alternatively, these nucleic acids can be synthesized in vitro by well-known chemical synthesis techniques, as described in, e.g., Adams (1983) J. Am. Chem. Soc. 105:661; Belousov (1997) Nucleic Acids Res. 25:3440-3444; Frenkel (1995) Free Radic. Biol. Med. 19:373-380; Blommers (1994) Biochemistry 33:7886-7896; Narang (1979) Meth. Enzymol. 68:90; Brown (1979) Meth. Enzymol. 68:109; Beaucage (1981) Terra. Lett. 22:1859; U.S. Pat. No. 4,458,066.

Techniques for the manipulation of nucleic acids, such as, e.g., subcloning, labeling probes (e.g., random-primer labeling using Klenow polymerase, nick translation, amplification), sequencing, hybridization and the like are well described in the scientific and patent literature, see, e.g., Sambrook, ed., MOLECULAR CLONING: A LABORATORY MANUAL (2ND ED.), Vols. 1-3, Cold Spring Harbor Laboratory, (1989); CURRENT PROTOCOLS IN MOLECULAR BIOLOGY, Ausubel, ed. John Wiley & Sons, Inc., New York (1997); LABORATORY TECHNIQUES IN BIOCHEMISTRY AND MOLECULAR BIOLOGY: HYBRIDIZATION WITH NUCLEIC ACID PROBES, Part I. Theory and Nucleic Acid Preparation, Tijssen, ed. Elsevier, N.Y. (1993).

Another useful means of obtaining and manipulating nucleic acids used to practice the methods of the invention is to clone from genomic samples, and, if desired, screen and re-clone inserts isolated or amplified from, e.g., genomic clones or cDNA clones. Sources of nucleic acid used in the methods of the invention include genomic or cDNA libraries contained in, e.g., mammalian artificial chromosomes (MACs), see, e.g., U.S. Pat. Nos. 5,721,118; 6,025,155; human artificial chromosomes, see, e.g., Rosenfeld (1997) Nat. Genet. 15:333-335; yeast artificial chromosomes (YAC); bacterial artificial chromosomes (BAC); P1 artificial chromosomes, see, e.g., Woon (1998) Genomics 50:306-316; P1-derived vectors (PACs), see, e.g., Kern (1997) Biotechniques 23:120-124; cosmids, recombinant viruses, phages or plasmids.

In one aspect, a nucleic acid encoding a polypeptide of the invention is assembled in appropriate phase with a leader sequence capable of directing secretion of the translated polypeptide or fragment thereof.

The invention provides fusion proteins and nucleic acids encoding them. A polypeptide of the invention can be fused to a heterologous peptide or polypeptide, such as N-terminal identification peptides which impart desired characteristics, such as increased stability or simplified purification. Peptides and polypeptides of the invention can also be synthesized and expressed as fusion proteins with one or more additional domains linked thereto for, e.g., producing a more immunogenic peptide, to more readily isolate a recombinantly synthesized peptide, to identify and isolate antibodies and antibody-expressing B cells, and the like. Detection and purification facilitating domains include, e.g., metal chelating peptides such as polyhistidine tracts and histidine-tryptophan modules that allow purification on immobilized metals, protein A domains that allow purification on immobilized immunoglobulin, and the domain utilized in the FLAGS extension/affinity purification system (Immunex Corp, Seattle Wash.). The inclusion of a cleavable linker sequences such as Factor Xa or enterokinase (Invitrogen, San Diego Calif.) between a purification domain and the motif-comprising peptide or polypeptide to facilitate purification. For example, an expression vector can include an epitope-encoding nucleic acid sequence linked to six histidine residues followed by a thioredoxin and an enterokinase cleavage site (see e.g., Williams (1995) Biochemistry 34:1787-1797; Dobeli (1998) Protein Expr. Purif. 12:404-414). The histidine residues facilitate detection and purification while the enterokinase cleavage site provides a means for purifying the epitope from the remainder of the fusion protein. Technology pertaining to vectors encoding fusion proteins and application of fusion proteins are well described in the scientific and patent literature, see e.g., Kroll (1993) DNA Cell. Biol., 12:441-53.

The term "isolated" as used herein refers to any substance removed from its native host; the substance need not be purified. For example "isolated nucleic acid" refers to a naturally-occurring nucleic acid that is not immediately contiguous with both of the sequences with which it is immediately contiguous (one on the 5' end and one on the 3' end) in the naturally-occurring genome of the organism from which it is derived. For example, an isolated nucleic acid can be, without limitation, a recombinant DNA molecule of any length, provided one of the nucleic acid sequences normally found immediately flanking that recombinant DNA molecule in a naturally-occurring genome is removed or absent. Thus, an isolated nucleic acid includes, without limitation, a recombinant DNA that exists as a separate molecule (e.g., a cDNA or a genomic DNA fragment produced by PCR or restriction endonuclease treatment) independent of other sequences as well as recombinant DNA that is incorporated into a vector, an autonomously replicating plasmid, a virus (e.g., a retrovirus, adenovirus, or herpes virus), or into the genomic DNA of a prokaryote or eukaryote. In addition, an isolated nucleic acid can include a recombinant DNA molecule that is part of a hybrid or fusion nucleic acid sequence.

In one aspect, the term "isolated" means that the material (e.g., a protein or nucleic acid of the invention) is removed from its original environment (e.g., the natural environment if it is naturally occurring). For example, a naturally-occurring polynucleotide or polypeptide present in a living animal is not isolated, but the same polynucleotide or polypeptide, separated from some or all of the coexisting materials in the natural system, is isolated. Such polynucleotides could be part of a vector and/or such polynucleotides or polypeptides could be part of a composition and still be isolated in that such vector or composition is not part of its natural environment.

In one aspect, the term "isolated" as used with reference to nucleic acids also can include any non-naturally-occurring nucleic acid since non-naturally-occurring nucleic acid sequences are not found in nature and do not have immediately contiguous sequences in a naturally-occurring genome. For example, non-naturally-occurring nucleic acid such as an engineered nucleic acid is considered to be isolated nucleic acid. Engineered nucleic acid can be made using common molecular cloning or chemical nucleic acid synthesis techniques. Isolated non-naturally-occurring nucleic acid can be independent of other sequences, or incorporated into a vector, an autonomously replicating plasmid, a virus (e.g., a retrovirus, adenovirus, or herpes virus), or the genomic DNA of a prokaryote or eukaryote. In addition, a non-naturally-occurring nucleic acid can include a nucleic acid molecule that is part of a hybrid or fusion nucleic acid sequence.

Purified: The term "purified" as used herein does not require absolute purity, but rather is intended as a relative term. Thus, for example, a purified polypeptide or nucleic acid preparation can be one in which the subject polypeptide or nucleic acid is at a higher concentration than the polypeptide or nucleic acid would be in its natural environment within an organism or at a higher concentration than in the environment from which it was removed. Individual nucleic acids obtained from a library have been conventionally purified to electrophoretic homogeneity. The sequences obtained from these clones could not be obtained directly either from the library or from total human DNA. The purified nucleic acids of the invention have been purified from the remainder of the genomic DNA in the organism by at least $10^4$-$10^6$ fold. In one aspect, the term "purified" includes nucleic acids which have been purified from the remainder of the genomic DNA or from other sequences in a library or other environment by at least one order of magnitude, e.g., in one aspect, two or three orders, or, four or five orders of magnitude.

Enriched: In one aspect, to be "enriched" a nucleic acid will represent 5% or more of the number of nucleic acid inserts in a population of nucleic acid backbone molecules. Backbone molecules according to the invention include nucleic acids such as expression vectors, self-replicating nucleic acids, viruses, integrating nucleic acids and other vectors or nucleic acids used to maintain or manipulate a nucleic acid insert of interest. Typically, the enriched nucleic acids represent 15% or more of the number of nucleic acid inserts in the population of recombinant backbone molecules. More typically, the enriched nucleic acids represent 50% or more of the number of nucleic acid inserts in the population of recombinant backbone molecules. In a one aspect, the enriched nucleic acids represent 90% or more of the number of nucleic acid inserts in the population of recombinant backbone molecules.

In one aspect, "amino acid" or "amino acid sequence" as used herein refer to an oligopeptide, peptide, polypeptide, or protein sequence, or to a fragment, portion, or subunit of any of these and to naturally occurring or synthetic molecules. "Amino acid" or "amino acid sequence" include an oligopeptide, peptide, polypeptide, or protein sequence, or to a fragment, portion, or subunit of any of these, and to naturally occurring or synthetic molecules. The term "polypeptide" as used herein, refers to amino acids joined to each other by peptide bonds or modified peptide bonds, i.e., peptide isosteres and may contain modified amino acids other than the 20 gene-encoded amino acids. The polypeptides may be modified by either natural processes, such as post-translational processing, or by chemical modification techniques which are well known in the art. Modifications can occur anywhere in the polypeptide, including the peptide backbone, the amino acid side-chains and the amino or carboxyl termini. It will be appreciated that the same type of modification may be present in the same or varying degrees at several sites in a given polypeptide. Also a given polypeptide may have many types of modifications. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of a phosphatidylinositol, cross-linking cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristolyation, oxidation, pegylation, glucan hydrolase processing, phosphorylation, prenylation, racemization, selenoylation, sulfation and transfer-RNA mediated addition of amino acids to protein such as arginylation. (See Creighton, T. E., Proteins—Structure and Molecular Properties 2nd Ed., W. H. Freeman and Company, New York (1993); *Posttranslational Covalent Modification of Proteins*, B. C. Johnson, Ed., Academic Press, New York, pp. 1-12 (1983)). The peptides and polypeptides of the invention also include all "mimetic" and "peptidomimetic" forms, as described in further detail, below.

As used herein, the term "recombinant" means that the nucleic acid is adjacent to a "backbone" nucleic acid to which it is not adjacent in its natural environment. Additionally, to be "enriched" the nucleic acids will represent 5% or more of the number of nucleic acid inserts in a population of nucleic acid backbone molecules. Backbone molecules according to the invention include nucleic acids such as expression vectors, self-replicating nucleic acids, viruses, integrating nucleic acids and other vectors or nucleic acids used to maintain or manipulate a nucleic acid insert of interest. Typically, the enriched nucleic acids represent 15% or more of the number of nucleic acid inserts in the population of recombinant backbone molecules. More typically, the enriched nucleic acids represent 50% or more of the number of nucleic acid inserts in the population of recombinant backbone molecules. In a one aspect, the enriched nucleic acids represent 90% or more of the number of nucleic acid inserts in the population of recombinant backbone molecules.

The term "saturation mutagenesis", Gene Site Saturation Mutagenesis, or "GSSM" includes a method that uses degenerate oligonucleotide primers to introduce point mutations into a polynucleotide, as described in detail, below.

The term "optimized directed evolution system" or "optimized directed evolution" includes a method for reassembling fragments of related nucleic acid sequences, e.g., related genes, and explained in detail, below.

The term "synthetic ligation reassembly" or "SLR" includes a method of ligating oligonucleotide fragments in a non-stochastic fashion, and explained in detail, below.

Transcriptional and Translational Control Sequences

The invention provides nucleic acid (e.g., DNA) sequences of the invention operatively linked to expression (e.g., transcriptional or translational) control sequence(s), e.g., promoters or enhancers, to direct or modulate RNA synthesis/expression. The expression control sequence can be in an expression vector. Exemplary bacterial promoters include lad, lacZ, T3, T7, gpt, lambda PR, PL and trp. Exemplary eukaryotic promoters include CMV immediate early, HSV thymidine kinase, early and late SV40, LTRs from retrovirus, and mouse metallothionein I.

Promoters suitable for expressing a polypeptide in bacteria include the *E. coli* lac or trp promoters, the lad promoter, the lacZ promoter, the T3 promoter, the T7 promoter, the gpt promoter, the lambda PR promoter, the lambda PL promoter, promoters from operons encoding glycolytic enzymes such as 3-phosphoglycerate kinase (PGK), and the acid phosphatase promoter. Eukaryotic promoters include the CMV immediate early promoter, the HSV thymidine kinase promoter, heat shock promoters, the early and late SV40 promoter, LTRs from retroviruses, and the mouse metallothionein-I promoter. Other promoters known to control expression of genes in prokaryotic or eukaryotic cells or their viruses may also be used. Promoters suitable for expressing the polypeptide or fragment thereof in bacteria include the *E. coli* lac or trp promoters, the lad promoter, the lacZ promoter, the T3 promoter, the 77 promoter, the gpt promoter, the lambda $P_R$ promoter, the lambda Pi promoter, promoters from operons encoding glycolytic enzymes such as 3-phosphoglycerate kinase (PGK) and the acid phosphatase promoter. Fungal promoters include the α-factor promoter. Eukaryotic promoters include the CMV immediate early promoter, the HSV thymidine kinase promoter, heat shock promoters, the early and late SV40 promoter, LTRs from retroviruses and the mouse metallothionein-I promoter. Other promoters known to control expression of genes in prokaryotic or eukaryotic cells or their viruses may also be used.

As used herein, the term "promoter" includes all sequences capable of driving transcription of a coding sequence in a cell, e.g., a plant cell. Thus, promoters used in the constructs of the invention include cis-acting transcriptional control elements and regulatory sequences that are involved in regulating or modulating the timing and/or rate of transcription of a gene. For example, a promoter can be a ezs-acting transcriptional control element, including an enhancer, a promoter, a transcription terminator, an origin of replication, a chromosomal integration sequence, 5' and 3' untranslated regions, or an intronic sequence, which are involved in transcriptional regulation. These cis-acting sequences typically interact with proteins or other biomolecules to carry out (turn on/off, regulate, modulate, etc.) transcription. "Constitutive" promoters are those that drive expression continuously under most environmental conditions and states of development or cell differentiation. "Inducible" or "regulatable" promoters direct expression of the nucleic acid of the invention under the influence of environmental conditions or developmental conditions. Examples of environmental conditions that may affect transcription by inducible promoters include anaerobic conditions, elevated temperature, drought, or the presence of light.

"Tissue-specific" promoters are transcriptional control elements that are only active in particular cells or tissues or organs, e.g., in plants or animals. Tissue-specific regulation may be achieved by certain intrinsic factors which ensure that genes encoding proteins specific to a given tissue are expressed. Such factors are known to exist in mammals and plants so as to allow for specific tissues to develop.

Tissue-Specific Plant Promoters

The invention provides expression cassettes that can be expressed in a tissue-specific manner, e.g., that can express an ammonia lyase, e.g., phenylalanine ammonia lyase, tyrosine ammonia lyase and/or histidine ammonia lyase enzyme of the invention in a tissue-specific manner. The invention also provides plants or seeds that express an ammonia lyase, e.g., phenylalanine ammonia lyase, tyrosine ammonia lyase and/or histidine ammonia lyase enzyme of the invention in a tissue-specific manner. The tissue-specificity can be seed specific, stem specific, leaf specific, root specific, fruit specific and the like.

The term "plant" includes whole plants, plant parts (e.g., leaves, stems, flowers, roots, etc.), plant protoplasts, seeds and plant cells and progeny of same. The class of plants which can be used in the method of the invention is generally as broad as the class of higher plants amenable to transformation techniques, including angiosperms (monocotyledonous and dicotyledonous plants), as well as gymnosperms. It includes plants of a variety of ploidy levels, including polyploid, diploid, haploid and hemizygous states. As used herein, the term "transgenic plant" includes plants or plant cells into which a heterologous nucleic acid sequence has been inserted, e.g., the nucleic acids and various recombinant constructs (e.g., expression cassettes) of the invention.

hi one aspect, a constitutive promoter such as the CaMV 35S promoter can be used for expression in specific parts of the plant or seed or throughout the plant. For example, for overexpression, a plant promoter fragment can be employed which will direct expression of a nucleic acid in some or all tissues of a plant, e.g., a regenerated plant. Such promoters are referred to herein as "constitutive" promoters and are active under most environmental conditions and states of development or cell differentiation. Examples of constitutive promoters include the cauliflower mosaic virus (CaMV) 35S transcription initiation region, the 1'- or T-promoter derived from T-DNA of *Agrobacterium tumefaciens*, and other transcription initiation regions from various plant genes known to those of skill. Such genes include, e.g., ACTII from *Arabidopsis* (Huang (1996) *Plant Mol. Biol.* 33:125-139); Cat3 from *Arabidopsis* (GenBankNo. U43147, Zhong (1996) *Mol. Gen. Genet.* 251:196-203); the gene encoding stearoyl-acyl carrier protein desaturase from *Brassica napus* (Genbank No. X74782, Solocombe (1994) *Plant Physiol.* 104:1 167-1 176); GPcI from maize (GenBank No. X15596; Martinez (1989) *J. Mol. Biol.* 208:551-565); the Gpc2 from maize (GenBank No. U45855, Manjunath (1997) *Plant Mol. Biol.* 33:97-1 12); plant promoters described in U.S. Pat. Nos. 4,962,028; 5,633,440.

The invention uses tissue-specific or constitutive promoters derived from viruses which can include, e.g., the tobamovirus subgenomic promoter (Kumagai (1995) Proc. Natl. Acad. Sci. USA 92:1679-1683; the rice tungro bacilliform virus (RTBV), which replicates only in phloem cells in infected rice plants, with its promoter which drives strong phloem-specific reporter gene expression; the cassaya vein mosaic virus (CVMV) promoter, with highest activity in vascular elements, in leaf mesophyll cells, and in root tips (Verdaguer (1996) Plant MoI. Biol. 31:1129-1 139).

Alternatively, the plant promoter may direct expression of ammonia lyase, e.g., phenylalanine ammonia lyase, tyrosine ammonia lyase and/or histidine ammonia lyase enzyme-expressing nucleic acid in a specific tissue, organ or cell type (i.e. tissue-specific promoters) or may be otherwise under more precise environmental or developmental control or under the control of an inducible promoter. Examples of environmental conditions that may affect transcription include anaerobic conditions, elevated temperature, the presence of light, or sprayed with chemicals/hormones. For example, the invention incorporates the drought-inducible promoter of maize (Busk (1997) supra); the cold, drought, and high salt inducible promoter from potato (Kirch (1997) Plant MoI. Biol. 33:897 909).

Tissue-specific promoters can promote transcription only within a certain time frame of developmental stage within that tissue. See, e.g., Blazquez (1998) Plant Cell 10:791-800, characterizing the *Arabidopsis* LEAFY gene promoter. See also Cardon (1997) *Plant J* 12:361-11, describing the transcription factor SPL3, which recognizes a conserved sequence motif in the promoter region of the *A. thaliana* floral meristem identity gene API; and Mandel (1995) Plant Molecular Biology, Vol. 29, pp 995-1004, describing the meristem promoter eIF4. Tissue specific promoters which are active throughout the life cycle of a particular tissue can be used. In one aspect, the nucleic acids of the invention are operably linked to a promoter active primarily only in cotton fiber cells. In one aspect, the nucleic acids of the invention are operably linked to a promoter active primarily during the stages of cotton fiber cell elongation, e.g., as described by Rinehart (1996) supra. The nucleic acids can be operably linked to the Fb12A gene promoter to be preferentially expressed in cotton fiber cells (Ibid). See also, John (1997) Proc. Natl. Acad. Sci. USA 89:5769-5773; John, et al., U.S. Pat. Nos. 5,608,148 and 5,602,321, describing cotton fiber-specific promoters and methods for the construction of transgenic cotton plants. Root-specific promoters may also be used to express the nucleic acids of the invention. Examples of root-specific promoters include the promoter from the alcohol dehydrogenase gene (DeLisle (1990) Int. Rev. Cytol. 123:39-60). Other promoters that can be used to express the nucleic acids of the invention include, e.g., ovule-specific, embryo-specific, endosperm-specific, integument-specific, seed coat-specific promoters, or some combination thereof; a leaf-specific promoter (see, e.g., Busk (1997) Plant J. 11:1285 1295, describing a leaf-specific promoter in maize); the ORF 13 promoter from *Agrobacterium rhizogenes* (which exhibits high activity in roots, see, e.g., Hansen (1997) supra); a maize pollen specific promoter (see, e.g., Guerrero (1990) MoI. Gen. Genet. 224:161 168); a tomato promoter active during fruit ripening, senescence and abscission of leaves and, to a lesser extent, of flowers can be used (see, e.g., Blume (1997) Plant J. 12:731 746); a pistil-specific promoter from the potato SK2 gene (see, e.g., Ficker (1997) Plant MoI. Biol. 35:425 431); the Blec4 gene from pea, which is active in epidermal tissue of vegetative and floral shoot apices of transgenic alfalfa making it a useful tool to target the expression of foreign genes to the epidermal layer of actively growing shoots or fibers; the ovule-specific BEL1 gene (see, e.g., Reiser (1995) Cell 83:735-742, GenBankNo. U39944); and/or, the promoter in Klee, U.S. Pat. No. 5,589,583, describing a plant promoter region is capable of conferring high levels of transcription in meristematic tissue and/or rapidly dividing cells.

Alternatively, plant promoters which are inducible upon exposure to plant hormones, such as auxins, are used to express the nucleic acids of the invention. For example, the invention can use the auxin-response elements E1 promoter fragment (AuxREs) in the soybean {*Glycine max* L.) (Liu (1997) Plant Physiol. 115:397-407); the auxin-responsive *Arabidopsis* GST6 promoter (also responsive to salicylic acid and hydrogen peroxide) (Chen (1996) Plant J. 10: 955-966); the auxin-inducible parC promoter from tobacco (Sakai (1996) 37:906-913); a plant biotin response element (Streit (1997) MoI. Plant Microbe Interact. 10:933-937); and, the promoter responsive to the stress hormone abscisic acid (Sheen (1996) Science 274:1900-1902).

The nucleic acids of the invention can also be operably linked to plant promoters which are inducible upon exposure to chemicals reagents which can be applied to the plant, such as herbicides or antibiotics. For example, the maize In2-2 promoter, activated by benzenesulfonamide herbicide safeners, can be used (De Veylder (1997) Plant Cell Physiol. 38:568-577); application of different herbicide safeners induces distinct gene expression patterns, including expression in the root, hydathodes, and the shoot apical meristem. Coding sequence can be under the control of, e.g., a tetracycline-inducible promoter, e.g., as described with transgenic tobacco plants containing the *Avena sativa* L. (oat) arginine decarboxylase gene (Masgrau (1997) Plant J. 11:465-473); or, a salicylic acid-responsive element (Stange (1997) Plant J. 11:1315-1324). Using chemically-{e.g., hormone- or pesticide-) induced promoters, i.e., promoter responsive to a chemical which can be applied to the transgenic plant in the field, expression of a polypeptide of the invention can be induced at a particular stage of development of the plant. Thus, the invention also provides for transgenic plants containing an inducible gene encoding for polypeptides of the invention whose host range is limited to target plant species, such as corn, rice, barley, wheat, potato or other crops, inducible at any stage of development of the crop.

One of skill will recognize that a tissue-specific plant promoter may drive expression of operably linked sequences in tissues other than the target tissue. Thus, a tissue-specific promoter is one that drives expression preferentially in the target tissue or cell type, but may also lead to some expression in other tissues as well.

The nucleic acids of the invention can also be operably linked to plant promoters which are inducible upon exposure to chemicals reagents. These reagents include, e.g., herbicides, synthetic auxins, or antibiotics which can be applied, e.g., sprayed, onto transgenic plants. Inducible expression of the ammonia lyase, e.g., phenylalanine ammonia lyase, tyrosine ammonia lyase and/or histidine ammonia lyase enzyme-producing nucleic acids of the invention will allow the grower to select plants with the optimal ammonia lyase, e.g., phenylalanine ammonia lyase, tyrosine ammonia lyase and/or histidine ammonia lyase enzyme expression and/or activity. The development of plant parts can thus controlled. In this way the invention provides the means to facilitate the harvesting of plants and plant parts. For example, in various embodiments, the maize Iii2-2 promoter, activated by benzenesulfonamide herbicide safeners, is used (De Veylder (1997) Plant Cell Physiol. 38:568-577); application of different herbicide safeners induces distinct gene expression patterns, including expression in the root, hydathodes, and the shoot apical meristem. Coding sequences of the invention are also under the control of a tetracycline-inducible promoter, e.g., as described with transgenic tobacco plants containing *iheAvena saliva* L. (oat) arginine decarboxylase gene (Masgrau (1997) Plant J. 11:465-473); or, a salicylic acid-responsive element (Stange (1997) Plant J. 11:1315-1324).

In some aspects, proper polypeptide expression may require polyadenylation region at the 3'-end of the coding region. The polyadenylation region can be derived from the natural gene, from a variety of other plant (or animal or other) genes, or from genes in the *Agrobacterial* T-DNA.

Expression Cassettes, Vectors and Cloning Vehicles

The invention provides expression cassettes and vectors and cloning vehicles comprising nucleic acids of the invention, e.g., sequences encoding the ammonia lyase, e.g., phenylalanine ammonia lyase, tyrosine ammonia lyase and/or histidine ammonia lyase enzymes of the invention. Expression vectors and cloning vehicles of the invention can comprise viral particles, baculovirus, phage, plasmids, phagemids, cosmids, fosmids, bacterial artificial chromosomes, viral DNA (e.g., vaccinia, adenovirus, foul pox vims, pseudorabies and derivatives of SV40), P1-based artificial chromosomes, yeast plasmids, yeast artificial chromosomes, and any other vectors specific for specific hosts of interest (such as *bacillus, Aspergillus* and yeast). Vectors of the invention can include chromosomal, non-chromosomal and synthetic DNA sequences. Large numbers of suitable vectors are known to those of skill in the art, and are commercially available. Exemplary vectors are include: bacterial: pQE vectors (Qiagen), pBLUESCRIPT plasmids, pNH vectors, (lambda-ZAP vectors (Stratagene); ptrc99a, pKK223-3, pDR540, pRIT2T (Pharmacia); Eukaryotic: pXT1, pSG5 (Stratagene), pSVK3, pBPV, pMSG, pSVLSV40 (Pharmacia). However, any other plasmid or other vector may be used so long as they are replicable and viable in the host. Low copy number or high copy number vectors may be employed with the present invention.

"Plasmids" can be commercially available, publicly available on an unrestricted basis, or can be constructed from available plasmids in accord with published procedures. Equivalent plasmids to those described herein are known in the art and will be apparent to the ordinarily skilled artisan.

The term "expression cassette" as used herein refers to a nucleotide sequence which is capable of affecting expression of a structural gene (i.e., a protein coding sequence, such as an ammonia lyase, e.g., phenylalanine ammonia lyase, tyrosine ammonia lyase and/or histidine ammonia lyase enzyme of the invention) in a host compatible with such sequences. Expression cassettes include at least a promoter operably linked with the polypeptide coding sequence; and, optionally, with other sequences, e.g., transcription termination signals. Additional factors necessary or helpful in effecting expression may also be used, e.g., enhancers, alpha-factors. Thus, expression cassettes also include plasmids, expression vectors, recombinant viruses, any form of recombinant "naked DNA" vector, and the like. A "vector" comprises a nucleic acid which can infect, transfect, transiently or permanently transduce a cell. It will be recognized that a vector can be a naked nucleic acid, or a nucleic acid complexed with protein or lipid. The vector optionally comprises viral or bacterial nucleic acids and/or proteins, and/or membranes (e.g., a cell membrane, a viral lipid envelope, etc.). Vectors include, but are not limited to replicons (e.g., RNA replicons, bacteriophages) to which fragments of DNA maybe attached and become replicated. Vectors thus include, but are not limited to RNA, autonomous self-replicating circular or linear DNA or RNA (e.g., plasmids, viruses, and the like, see, e.g., U.S. Pat. No. 5,217,879), and include both the expression and non-expression plasmids. Where a recombinant microorganism or cell culture is described as hosting an "expression vector" this includes both extra-chromosomal circular and linear DNA and DNA that has been incorporated into the host chromosome(s). Where a vector is being maintained by a host cell, the vector may either be stably replicated by the cells during mitosis as an autonomous structure, or is incorporated within the host's genome.

The expression vector can comprise a promoter, a ribosome binding site for translation initiation and a transcription terminator. The vector may also include appropriate sequences for amplifying expression. Mammalian expression vectors can comprise an origin of replication, any necessary ribosome binding sites, a polyadenylation site, splice donor and acceptor sites, transcriptional termination sequences, and 5' flanking non-transcribed sequences. In some aspects, DNA sequences derived from the SV40 splice and polyadenylation sites may be used to provide the required non-transcribed genetic elements.

In one aspect, the expression vectors contain one or more selectable marker genes to permit selection of host cells containing the vector. Such selectable markers include genes encoding dihydrofolate reductase or genes conferring neomycin resistance for eukaryotic cell culture, genes conferring tetracycline or ampicillin resistance in E. coli, and the S. cerevisiae TRP1 gene. Promoter regions can be selected from any desired gene using chloramphenicol transferase (CAT) vectors or other vectors with selectable markers.

Vectors for expressing the polypeptide or fragment thereof in eukaryotic cells can also contain enhancers to increase expression levels. Enhancers are cis-acting elements of DNA that can be from about 10 to about 300 bp in length. They can act on a promoter to increase its transcription. Exemplary enhancers include the SV40 enhancer on the late side of the replication origin by 100 to 270, the cytomegalovirus early promoter enhancer, the polyoma enhancer on the late side of the replication origin, and the adenovirus enhancers.

A nucleic acid sequence can be inserted into a vector by a variety of procedures. In general, the sequence is ligated to the desired position in the vector following digestion of the insert and the vector with appropriate restriction endonucleases. Alternatively, blunt ends in both the insert and the vector may be ligated. A variety of cloning techniques are known in the art, e.g., as described in Ausubel and Sambrook. Such procedures and others are deemed to be within the scope of those skilled in the art.

The vector can be in the form of a plasmid, a viral particle, or a phage. Other vectors include chromosomal, non-chromosomal and synthetic DNA sequences, derivatives of SV40; bacterial plasmids, phage DNA, baculovirus, yeast plasmids, vectors derived from combinations of plasmids and phage DNA, viral DNA such as vaccinia, adenovirus, fowl pox virus, and pseudorabies. A variety of cloning and expression vectors for use with prokaryotic and eukaryotic hosts are described by, e.g., Sambrook.

Particular bacterial vectors which can be used include the commercially available plasmids comprising genetic elements of the well known cloning vector pBR322 (ATCC 37017), ρKK223-3 (Pharmacia Fine Chemicals, Uppsala, Sweden), GEM1 (Promega Biotec, Madison, Wis., USA) pQE70, pQE60, pQE-9 (Qiagen), pD 10, psiXl 74 pBLUE-SCRIPT II KS, pNH8A, pNH16a, pNH18A, pNH46A (Stratagene), ptrc99a, pKK223-3, pKK233-3, DR540, pRIT5 (Pharmacia), pKK232-8 and pCM7. Particular eukaryotic vectors include pSV2CAT, pOG44, pXT1, pSG (Stratagene) pSVK3, pBPV, pMSG, and pSVL (Pharmacia). However, any other vector may be used as long as it is replicable and viable in the host cell.

The nucleic acids of the invention can be expressed in expression cassettes, vectors or viruses and transiently or stably expressed in plant cells and seeds. One exemplary transient expression system uses episomal expression systems, e.g., cauliflower mosaic virus (CaMV) viral RNA generated in the nucleus by transcription of an episomal mini-chromosome containing supercoiled DNA, see, e.g., Covey (1990) Proc. Natl. Acad. Sci. USA 87:1633-1637. Alternatively, coding sequences, i.e., all or sub-fragments of sequences of the invention can be inserted into a plant host cell genome becoming an integral part of the host chromosomal DNA. Sense or antisense transcripts can be expressed in this manner. A vector comprising the sequences (e.g., promoters or coding regions) from nucleic acids of the invention can comprise a marker gene that confers a selectable phenotype on a plant cell or a seed. For example, the marker may encode biocide resistance, particularly antibiotic resistance, such as resistance to kanamycin, G418, bleomycin, hygromycin, or herbicide resistance, such as resistance to chlorosulfuron or Basta.

Expression vectors capable of expressing nucleic acids and proteins in plants are well known in the art, and can include, e.g., vectors from Agrobacterium spp., potato virus X (see, e.g., Angell (1997) EMBO J. 16:3675-3684), tobacco mosaic virus (see, e.g., Casper (1996) Gene 173:69-73), tomato bushy stunt virus (see, e.g., Hillman (1989) Virology 169:42-50), tobacco etch virus (see, e.g., Dolja (1997) Virology 234: 243-252), bean golden mosaic virus (see, e.g., Morinaga (1993) Microbiol Immunol. 37:471-476), cauliflower mosaic virus (see, e.g., Cecchini (1997) MoI. Plant Microbe Interact. 10:1094-1101), maize Ac/Ds transposable element (see, e.g., Rubin (1997) MoI. Cell. Biol. 17:6294-6302; Kunze (1996) Curr. Top. Microbiol. Immunol. 204:161-194), and the maize suppressor-mutator (Spm) transposable element (see, e.g., Schlappi (1996) Plant MoI. Biol. 32:717-725); and derivatives thereof.

In one aspect, the expression vector can have two replication systems to allow it to be maintained in two organisms, for example in mammalian or insect cells for expression and in a prokaryotic host for cloning and amplification. Furthermore, for integrating expression vectors, the expression vector can contain at least one sequence homologous to the host cell genome. It can contain two homologous sequences which flank the expression construct. The integrating vector can be directed to a specific locus in the host cell by selecting the appropriate homologous sequence for inclusion in the vector. Constructs for integrating vectors are well known in the art.

Expression vectors of the invention may also include a selectable marker gene to allow for the selection of bacterial strains that have been transformed, e.g., genes which render the bacteria resistant to drugs such as ampicillin, chloramphenicol, erythromycin, kanamycin, neomycin and tetracycline. Selectable markers can also include biosynthetic genes, such as those in the histidine, tryptophan and leucine biosynthetic pathways.

The DNA sequence in the expression vector is operatively linked to an appropriate expression control sequence(s) (promoter) to direct RNA synthesis. Particular named bacterial promoters include lad, lacZ, T3, T7, gpt, lambda PR, $P_L$ and trp. Eukaryotic promoters include CMV immediate early, HSV thymidine kinase, early and late SV40, LTRs from retrovirus and mouse metallothionein-I. Selection of the appropriate vector and promoter is well within the level of ordinary skill in the art. The expression vector also contains a ribosome binding site for translation initiation and a transcription terminator. The vector may also include appropriate sequences for amplifying expression. Promoter regions can be selected from any desired gene using chloramphenicol transferase (CAT) vectors or other vectors with selectable markers. In addition, the expression vectors in one aspect contain one or more selectable marker genes to provide a phenotypic trait for selection of transformed host cells such as dihydrofolate reductase or neomycin resistance for eukaryotic cell culture, or such as tetracycline or ampicillin resistance in *E. coli*.

Mammalian expression vectors may also comprise an origin of replication, any necessary ribosome binding sites, a polyadenylation site, splice donor and acceptor sites, transcriptional termination sequences and 5' flanking nontranscribed sequences. In some aspects, DNA sequences derived from the SV40 splice and polyadenylation sites may be used to provide the required nontranscribed genetic elements.

Vectors for expressing the polypeptide or fragment thereof in eukaryotic cells may also contain enhancers to increase expression levels. Enhancers are cis-acting elements of DNA, usually from about 10 to about 300 bp in length that act on a promoter to increase its transcription. Examples include the SV40 enhancer on the late side of the replication origin by 100 to 270, the cytomegalovirus early promoter enhancer, the polyoma enhancer on the late side of the replication origin and the adenovirus enhancers.

In addition, the expression vectors typically contain one or more selectable marker genes to permit selection of host cells containing the vector. Such selectable markers include genes encoding dihydrofolate reductase or genes conferring neomycin resistance for eukaryotic cell culture, genes conferring tetracycline or ampicillin resistance in *E. coli* and the *S. cerevisiae* TRP1 gene.

In some aspects, the nucleic acid encoding one of the polypeptides of the invention, or fragments comprising at least about 5, 10, 15, 20, 25, 30, 35, 40, 50, 75, 100, or 150 consecutive amino acids thereof is assembled in appropriate phase with a leader sequence capable of directing secretion of the translated polypeptide or fragment thereof. Optionally, the nucleic acid can encode a fusion polypeptide in which one of the polypeptides of the invention, or fragments comprising at least 5, 10, 15, 20, 25, 30, 35, 40, 50, 75, 100, or 150 consecutive amino acids thereof is fused to heterologous peptides or polypeptides, such as N-terminal identification peptides which impart desired characteristics, such as increased stability or simplified purification.

The appropriate DNA sequence may be inserted into the vector by a variety of procedures. In general, the DNA sequence is ligated to the desired position in the vector following digestion of the insert and the vector with appropriate restriction endonucleases. Alternatively, blunt ends in both the insert and the vector may be ligated. A variety of cloning techniques are disclosed in Ausubel et al. Current Protocols in Molecular Biology, John Wiley 503 Sons, Inc. 1997 and Sambrook et al, Molecular Cloning: A Laboratory Manual 2nd Ed., Cold Spring Harbor Laboratory Press (1989. Such procedures and others are deemed to be within the scope of those skilled in the art.

The vector may be, for example, in the form of a plasmid, a viral particle, or a phage. Other vectors include chromosomal, nonchromosomal and synthetic DNA sequences, derivatives of SV40; bacterial plasmids, phage DNA, baculovirus, yeast plasmids, vectors derived from combinations of plasmids and phage DNA, viral DNA such as vaccinia, adenovirus, fowl pox virus and pseudorabies. A variety of cloning and expression vectors for use with prokaryotic and eukaryotic hosts are described by Sambrook, et al, Molecular Cloning: A Laboratory Manual, 2nd Ed., Cold Spring Harbor, N.Y., (1989).

Host Cells and Transformed Cells

The invention also provides a transformed cell comprising a nucleic acid sequence of the invention, e.g., a sequence encoding an ammonia lyase, e.g., phenylalanine ammonia lyase, tyrosine ammonia lyase and/or histidine ammonia lyase enzyme of the invention, or a vector of the invention. The host cell may be any of the host cells familiar to those skilled in the art, including prokaryotic cells, eukaryotic cells, such as bacterial cells, fungal cells, yeast cells, mammalian cells, insect cells, or plant cells. Exemplary bacterial cells include *E. coli, Streptomyces, Bacillus subtilis, Bacillus cereus, Salmonella typhimurium* and various species within the genera *Streptomyces* and *Staphylococcus*. Exemplary insect cells include *Drosophila* S2 and *Spodoptera* Sf9. Exemplary animal cells include CHO, COS or Bowes melanoma or any mouse or human cell line. The selection of an appropriate host is within the abilities of those skilled in the art. Techniques for transforming a wide variety of higher plant species are well known and described in the technical and scientific literature. See, e.g., Weising (1988) Ann. Rev. Genet. 22:421-477; U.S. Pat. No. 5,750,870.

The vector can be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, L, Basic Methods in Molecular Biology, (1986)).

In one aspect, the nucleic acids or vectors of the invention are introduced into the cells for screening, thus, the nucleic acids enter the cells in a manner suitable for subsequent expression of the nucleic acid. The method of introduction is largely dictated by the targeted cell type. Exemplary methods include $CaPO_4$ precipitation, liposome fusion, lipofection (e.g., LIPOFECTIN™), electroporation, viral infection, etc. The candidate nucleic acids may stably integrate into the genome of the host cell (for example, with retroviral introduction) or may exist either transiently or stably in the cytoplasm (i.e. through the use of traditional plasmids, utilizing standard regulatory sequences, selection markers, etc.). As many pharmaceutically important screens require human or model mammalian cell targets, retroviral vectors capable of transfecting such targets can be used.

Where appropriate, the engineered host cells can be cultured in conventional nutrient media modified as appropriate for activating promoters, selecting transformants or amplifying the genes of the invention. Following transformation of a suitable host strain and growth of the host strain to an appropriate cell density, the selected promoter may be induced by appropriate means (e.g., temperature shift or chemical induction) and the cells may be cultured for an additional period to allow them to produce the desired polypeptide or fragment thereof.

Cells can be harvested by centrifugation, disrupted by physical or chemical means, and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

The constructs in host cells can be used in a conventional manner to produce the gene product encoded by the recombinant sequence. Depending upon the host employed in a recombinant production procedure, the polypeptides produced by host cells containing the vector may be glycosylated or may be non-glycosylated. Polypeptides of the invention may or may not also include an initial methionine amino acid residue.

Cell-free translation systems can also be employed to produce a polypeptide of the invention. Cell-free translation systems can use mRNAs transcribed from a DNA construct comprising a promoter operably linked to a nucleic acid encoding the polypeptide or fragment thereof. In some aspects, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

The expression vectors can contain one or more selectable marker genes to provide a phenotypic trait for selection of transformed host cells such as dihydrofolate reductase or neomycin resistance for eukaryotic cell culture, or such as tetracycline or ampicillin resistance in *E. coli*.

Host cells containing the polynucleotides of interest, e.g., nucleic acids of the invention, can be cultured in conventional nutrient media modified as appropriate for activating promoters, selecting transformants or amplifying genes. The culture conditions, such as temperature, pH and the like, are those previously used with the host cell selected for expression and will be apparent to the ordinarily skilled artisan. The clones which are identified as having the specified enzyme activity may then be sequenced to identify the polynucleotide sequence encoding an enzyme having the enhanced activity.

The invention provides a method for overexpressing a recombinant ammonia lyase, e.g., phenylalanine ammonia lyase, tyrosine ammonia lyase and/or histidine ammonia lyase enzyme in a cell comprising expressing a vector comprising a nucleic acid of the invention, e.g., a nucleic acid comprising a nucleic acid sequence with at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more sequence identity to an exemplary sequence of the invention over a region of at least about 100 residues, wherein the sequence identities are determined by analysis with a sequence comparison algorithm or by visual inspection, or, a nucleic acid that hybridizes under stringent conditions to a nucleic acid sequence of the invention. The overexpression can be effected by any means, e.g., use of a high activity promoter, a dicistronic vector or by gene amplification of the vector.

The nucleic acids of the invention can be expressed, or overexpressed, in any in vitro or in vivo expression system. Any cell culture systems can be employed to express, or over-express, recombinant protein, including bacterial, insect, yeast, fungal or mammalian cultures. Over-expression can be effected by appropriate choice of promoters, enhancers, vectors (e.g., use of replicon vectors, dicistronic vectors (see, e.g., Gurtu (1996) Biochem. Biophys. Res. Commun. 229:295-8), media, culture systems and the like. In one aspect, gene amplification using selection markers, e.g., glutamine synthetase (see, e.g., Sanders (1987) Dev. Biol. Stand. 66:55-63), in cell systems are used to overexpress the polypeptides of the invention.

The host cell may be any of the host cells familiar to those skilled in the art, including prokaryotic cells, eukaryotic cells, mammalian cells, insect cells, or plant cells. As representative examples of appropriate hosts, there maybe mentioned: bacterial cells, such as *E. coli, Streptomyces, Bacillus subtilis, Bacillus cereus, Salmonella typhimurium* and various species within the genera *Streptomyces* and *Staphylococcus*, fungal cells, such as yeast, insect cells such as *Drosophila* S2 and *Spodoptera* Sf9, animal cells such as CHO, COS or Bowes melanoma and adenoviruses. The selection of an appropriate host is within the abilities of those skilled in the art.

The vector may be introduced into the host cells using any of a variety of techniques, including transformation, transfection, transduction, viral infection, gene guns, or Ti-mediated gene transfer. Particular methods include calcium phosphate transfection, DEAE-Dextran mediated transfection, lipofection, or electroporation (Davis, L., Dibner, M., Battey, I., Basic Methods in Molecular Biology, (1986)).

Where appropriate, the engineered host cells can be cultured in conventional nutrient media modified as appropriate for activating promoters, selecting transformants or amplifying the genes of the invention. Following transformation of a suitable host strain and growth of the host strain to an appropriate cell density, the selected promoter may be induced by appropriate means {e.g., temperature shift or chemical induction) and the cells may be cultured for an additional period to allow them to produce the desired polypeptide or fragment thereof.

Cells are typically harvested by centrifugation, disrupted by physical or chemical means and the resulting crude extract is retained for further purification. Microbial cells employed for expression of proteins can be disrupted by any convenient method, including freeze-thaw cycling, sonication, mechanical disruption, or use of cell lysing agents. Such methods are well known to those skilled in the art. The expressed polypeptide or fragment thereof can be recovered and purified from recombinant cell cultures by methods including ammonium sulfate or ethanol precipitation, acid extraction, anion or cation exchange chromatography, phosphocellulose chromatography, hydrophobic interaction chromatography, affinity chromatography, hydroxylapatite chromatography and lectin chromatography. Protein refolding steps can be used, as necessary, in completing configuration of the polypeptide. If desired, high performance liquid chromatography (HPLC) can be employed for final purification steps.

Various mammalian cell culture systems can also be employed to express recombinant protein. Examples of mammalian expression systems include the COS-7 lines of monkey kidney fibroblasts (described by Gluzman, *Cell,* 23:175, 1981) and other cell lines capable of expressing proteins from a compatible vector, such as the C 127, 3T3, CHO, HeLa and BHK cell lines.

The constructs in host cells can be used in a conventional manner to produce the gene product encoded by the recombinant sequence. Depending upon the host employed in a recombinant production procedure, the polypeptides produced by host cells containing the vector may be glycosylated or may be non-glycosylated. Polypeptides of the invention may or may not also include an initial methionine amino acid residue.

Alternatively, the polypeptides of the invention, or fragments comprising at least 5, 10, 15, 20, 25, 30, 35, 40, 50, 75, 100, or 150 or more consecutive amino acids thereof can be synthetically produced by conventional peptide synthesizers.

In other aspects, fragments or portions of the polypeptides may be employed for producing the corresponding full-length polypeptide by peptide synthesis; therefore, the fragments may be employed as intermediates for producing the full-length polypeptides.

Cell-free translation systems can also be employed to produce one of the polypeptides of the invention, or fragments comprising at least 5, 10, 15, 20, 25, 30, 35, 40, 50, 75, 100, or 150 or more consecutive amino acids thereof using mRNAs transcribed from a DNA construct comprising a promoter operably linked to a nucleic acid encoding the polypeptide or fragment thereof. In some aspects, the DNA construct may be linearized prior to conducting an in vitro transcription reaction. The transcribed mRNA is then incubated with an appropriate cell-free translation extract, such as a rabbit reticulocyte extract, to produce the desired polypeptide or fragment thereof.

Amplification of Nucleic Acids

In practicing the invention, nucleic acids of the invention and nucleic acids encoding the ammonia lyase, e.g., phenylalanine ammonia lyase, tyrosine ammonia lyase and/or histidine ammonia lyase enzymes of the invention, or modified nucleic acids of the invention, can be reproduced by amplification. Amplification can also be used to clone or modify the nucleic acids of the invention. Thus, the invention provides amplification primer sequence pairs for amplifying nucleic acids of the invention, including exemplary sequences of the invention, e.g., all odd SEQ ID NO:s between SEQ ID NO:1 and SEQ ID NO. 251. One of skill in the art can design amplification primer sequence pairs for any part of or the full length of these sequences.

In one aspect, the invention provides a nucleic acid amplified by a primer pair of the invention, e.g., a primer pair as set forth by about the first (the 5') 11, 12, 13, 14, 15, 16, 17, 18, 19, 20, 21, 22, 23, 24, or 25 or more residues of a nucleic acid of the invention, and about the first (the 5') 11, 12, 13, 14, 15, 16, 17, 18, 19, 20, 21, 22, 23, 24, or 25 or more residues of the complementary strand.

The invention provides an amplification primer sequence pair for amplifying a nucleic acid encoding a polypeptide having an ammonia lyase, e.g., phenylalanine ammonia lyase, tyrosine ammonia lyase and/or histidine ammonia lyase enzyme activity, wherein the primer pair is capable of amplifying a nucleic acid comprising a sequence of the invention, or fragments or subsequences thereof. One or each member of the amplification primer sequence pair can comprise an oligonucleotide comprising at least about 10 to 50 or more consecutive bases of the sequence, or about 11, 12, 13, 14, 15, 16, 17, 18, 19, 20, 21, 22, 23, 24, or 25 or more consecutive bases of the sequence. The invention provides amplification primer pairs, wherein the primer pair comprises a first member having a sequence as set forth by about the first (the 5') 11, 12, 13, 14, 15, 16, 17, 18, 19, 20, 21, 22, 23, 24, or 25 or more residues of a nucleic acid of the invention, and a second member having a sequence as set forth by about the first (the 5') 12, 13, 14, 15, 16, 17, 18, 19, 20, 21, 22, 23, 24, or 25 or more residues of the complementary strand of the first member. The invention provides ammonia lyase, e.g., phenylalanine ammonia lyase, tyrosine ammonia lyase and/or histidine ammonia lyase enzymes generated by amplification, e.g., polymerase chain reaction (PCR), using an amplification primer pair of the invention. The invention provides methods of making an ammonia lyase, e.g., phenylalanine ammonia lyase, tyrosine ammonia lyase and/or histidine ammonia lyase enzyme by amplification, e.g., polymerase chain reaction (PCR), using an amplification primer pair of the invention, hi one aspect, the amplification primer pair amplifies a nucleic acid from a library, e.g., a gene library, such as an environmental library.

Amplification reactions can also be used to quantify the amount of nucleic acid in a sample (such as the amount of message in a cell sample), label the nucleic acid (e.g., to apply it to an array or a blot), detect the nucleic acid, or quantify the amount of a specific nucleic acid in a sample. In one aspect of the invention, message isolated from a cell or a cDNA library are amplified.

The skilled artisan can select and design suitable oligonucleotide amplification primers. Amplification methods are also well known in the art, and include, e.g., polymerase chain reaction, PCR (see, e.g., PCR PROTOCOLS, A GUIDE TO METHODS AND APPLICATIONS, ed. Innis, Academic Press, N.Y. (1990) and PCR STRATEGIES (1995), ed. Innis, Academic Press, Inc., N.Y., ligase chain reaction (LCR) (see, e.g., Wu (1989) Genomics 4:560; Landegren (1988) Science 241:1077; Barringer (1990) Gene 89:1 17); transcription amplification (see, e.g., Kwoh (1989) Proc. Natl. Acad. Sci. USA 86:1173); and, self-sustained sequence replication (see, e.g., Guatelli (1990) Proc. Natl. Acad. Sci. USA 87: 1874); Q Beta replicase amplification (see, e.g., Smith (1997) J. Clin. Microbiol. 35:1477-1491), automated Q-beta replicase amplification assay (see, e.g., Burg (1996) MoI. Cell. Probes 10:257-271) and other RNA polymerase mediated techniques (e.g., NASBA, Cangene, Mississauga, Ontario); see also Berger (1987) Methods Enzymol. 152:307-316; Sambrook; Ausubel; U.S. Pat. Nos. 4,683,195 and 4,683,202; Sooknanan (1995) Biotechnology 13:563-564.

Determining; the Degree of Sequence Identity

The invention provides nucleic acids comprising sequences having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity (homology) to an exemplary nucleic acid of the invention (e.g., e.g., all odd SEQ ID NO:s between SEQ ID NO:1 and SEQ ID NO:251) over a region of at least about 50, 75, 100, 150, 200, 250, 300, 350, 400, 450, 500, 550, 600, 650, 700, 750, 800, 850, 900, 950, 1000, 1050, 1100, 1150, 1200, 1250, 1300, 1350, 1400, 1450, 1500, 1550 or more, residues. The invention provides polypeptides comprising sequences having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity to an exemplary polypeptide of the invention (e.g., all even SEQ ID NO:s between SEQ ID NO:2 and SEQ ID NO:252, and subsequences thereof, including enzymatically active fragments thereof), and nucleic acids encoding them (including both strands, i.e., sense and nonsense, coding or noncoding). The extent of sequence identity (homology) may be determined using any computer program and associated parameters, including those described herein, such as BLAST 2.2.2. or FASTA version 3.0t78, with the default parameters.

Nucleic acid sequences of the invention can comprise at least 10, 15, 20, 25, 30, 35, 40, 50, 75, 100, 150, 200, 300, 400, or 500 or more consecutive nucleotides of an exemplary sequence of the invention and sequences substantially identical thereto. Homologous sequences and fragments of nucleic acid sequences of the invention can refer to a sequence having at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more sequence identity (homology) to these sequences.

The phrase "substantially identical" in the context of two nucleic acids or polypeptides, refers to two or more sequences that have, e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more nucleotide or amino acid residue (sequence) identity, when compared and aligned for maximum correspondence, as measured using one of the known sequence comparison algorithms or by visual inspection. In alternative aspects, the substantial identity exists over a region of at least about 100 or more residues and most commonly the sequences are substantially identical over at least about 150 to 200 or more residues. In some aspects, the sequences are substantially identical over the entire length of the coding regions.

The phrase "substantially identical" in the context of two nucleic acids or polypeptides, refers to two or more sequences that have, e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more nucleotide or amino acid residue (sequence) identity, when compared and aligned for maximum correspondence, as measured using one of the known sequence comparison algorithms or by visual inspection. In alternative aspects, the substantial identity exists over a region of at least about 100 or more residues and most commonly the sequences are substantially identical over at least about 150 to 200 or more residues. In some aspects, the sequences are substantially identical over the entire length of the coding regions.

Additionally a "substantially identical" amino acid sequence is a sequence that differs from a reference sequence by one or more conservative or non-conservative amino acid substitutions, deletions, or insertions. In one aspect, the substitution occurs at a site that is not the active site of the molecule, or, alternatively the substitution occurs at a site that is the active site of the molecule, provided that the polypeptide essentially retains its functional (enzymatic) properties. A conservative amino acid substitution, for example, substitutes one amino acid for another of the same class (e.g., substitution of one hydrophobic amino acid, such as isoleucine, valine, leucine, or methionine, for another, or substitution of one polar amino acid for another, such as substitution of arginine for lysine, glutamic acid for aspartic acid or glutamine for asparagine). One or more amino acids can be deleted, for example, from an ammonia lyase, e.g., phenylalanine ammonia lyase, tyrosine ammonia lyase and/or histidine ammonia lyase polypeptide, resulting in modification of the structure of the polypeptide, without significantly altering its biological activity. For example, amino- or carboxyl-terminal amino acids that are not required for ammonia lyase, e.g., phenylalanine ammonia lyase, tyrosine ammonia lyase and/or histidine ammonia lyase enzyme biological activity can be removed. Modified polypeptide sequences of the invention can be assayed for ammonia lyase, e.g., phenylalanine ammonia lyase, tyrosine ammonia lyase and/or histidine ammonia lyase enzyme biological activity by any number of methods, including contacting the modified polypeptide sequence with a substrate and determining whether the modified polypeptide decreases the amount of specific substrate in the assay or increases the bioproducts of the enzymatic reaction of a functional ammonia lyase, e.g., phenylalanine ammonia lyase, tyrosine ammonia lyase and/or histidine ammonia lyase polypeptide with the substrate.

Homology (sequence identity) may be determined using any of the computer programs and parameters described herein, including FASTA version 3.0t78 with the default parameters. Homologous sequences also include RNA sequences in which uridines replace the thymines in the nucleic acid sequences of the invention. The homologous sequences may be obtained using any of the procedures described herein or may result from the correction of a sequencing error. It will be appreciated that the nucleic acid sequences of the invention can be represented in the traditional single character format (See the inside back cover of Stryer, Lubert. Biochemistry, 3rd Ed., W. H Freeman & Co., New York.) or in any other format which records the identity of the nucleotides in a sequence.

As used herein, the terms "computer," "computer program" and "processor" are used in their broadest general contexts and incorporate all such devices, as described in detail, below. A "coding sequence of or a "sequence encodes" a particular polypeptide or protein, is a nucleic acid sequence which is transcribed and translated into a polypeptide or protein when placed under the control of appropriate regulatory sequences.

Various sequence comparison programs identified elsewhere in this patent specification are particularly contemplated for use in this aspect of the invention. Protein and/or nucleic acid sequence homologies may be evaluated using any of the variety of sequence comparison algorithms and programs known in the art. Such algorithms and programs include, but are by no means limited to, TBLASTN, BLASTP, FASTA, TFASTA and CLUSTALW (see, e.g., Pearson and Lipman, Proc. Natl. Acad. Sci. USA 85(8):2444-2448, 1988; Altschul et al, J. Mol. Biol. 215(3):403-410, 1990; Thompson Nucleic Acids Res. 22(2):4673-4680, 1994; Higgins et al, Methods Enzymol. 266:383-402, 1996; Altschul et al, J. Mol. Biol. 215(3):403-410, 1990; Altschul et al, Nature Genetics 3:266-272, 1993).

Homology or identity is often measured using sequence analysis software (e.g., Sequence Analysis Software Package of the Genetics Computer Group, University of Wisconsin Biotechnology Center, 1710 University Avenue, Madison, Wis. 53705). Such software matches similar sequences by assigning degrees of homology to various deletions, substitutions and other modifications. The terms "homology" and "identity" in the context of two or more nucleic acids or polypeptide sequences, refer to two or more sequences or subsequences that are the same or have a specified percentage of amino acid residues or nucleotides that are the same when compared and aligned for maximum correspondence over a comparison window or designated region as measured using any number of sequence comparison algorithms or by manual alignment and visual inspection.

For sequence comparison, typically one sequence acts as a reference sequence, to which test sequences are compared. When using a sequence comparison algorithm, test and reference sequences are entered into a computer, subsequence coordinates are designated, if necessary and sequence algorithm program parameters are designated. Default program parameters can be used, or alternative parameters can be designated. The sequence comparison algorithm then calculates the percent sequence identities for the test sequences relative to the reference sequence, based on the program parameters.

A "comparison window", as used herein, includes reference to a segment of any one of the number of contiguous positions selected from the group consisting of from 20 to 600, usually about 50 to about 200, more usually about 100 to about 150 in which a sequence maybe compared to a reference sequence of the same number of contiguous positions after the two sequences are optimally aligned. Methods of alignment of sequence for comparison are well-known in the art. Optimal alignment of sequences for comparison can be conducted, e.g., by the local homology algorithm of Smith & Waterman, Adv. Appl. Math. 2:482, 1981, by the homology alignment algorithm of Needleman & Wunsch, J. Mol. Biol 48:443, 1970, by the search for similarity method of person & Lipman, Proc. Nat'l. Acad. Sci. USA 85:2444, 1988, by computerized implementations of these algorithms (GAP, BEST-FIT, FASTA and TFASTA in the Wisconsin Genetics Software Package, Genetics Computer Group, 575 Science Dr., Madison, Wis.), or by manual alignment and visual inspection. Other algorithms for determining homology or identity include, for example, in addition to a BLAST program (Basic Local Alignment Search Tool at the National Center for Biological Information), ALIGN, AMAS (Analysis of Multiply Aligned Sequences), AMPS (Protein Multiple Sequence Alignment), ASSET (Aligned Segment Statistical Evaluation Tool), BANDS, BESTSCOR, BIOSCAN (Biological Sequence Comparative Analysis Node), BLIMPS (BLocks IMProved Searcher), FASTA, Intervals & Points, BMB, CLUSTAL V, CLUSTAL W, CONSENSUS, LCONSENSUS, WCONSENSUS, Smith-Waterman algorithm, DARWIN, Las Vegas algorithm, FNAT (Forced Nucleotide Alignment Tool), Framealign, Framesearch, DYNAMIC, FILTER, FSAP (Fristensky Sequence Analysis Package), GAP (Global Alignment Program), GENAL, GIBBS, GenQuest, ISSC (Sensitive Sequence Comparison), LALIGN (Local Sequence Alignment), LCP (Local Content Program), MACAW (Multiple Alignment Construction & Analysis Workbench), MAP (Multiple Alignment Program), MBLKP$_5$ MBLKN, PIMA (Pattern-Induced Multi-sequence Alignment), SAGA (Sequence Alignment by Genetic Algorithm) and WHAT-IF. Such alignment programs can also be used to screen genome databases to identify polynucleotide sequences having substantially identical sequences. A number of genome databases are available, for example, a substantial portion of the human genome is available as part of the Human Genome Sequencing Project (Gibbs, 1995). At least twenty-one other genomes have already been sequenced, including, for example, *M. genitalium* (Fraser et al, 1995), *M. jannaschii* (Bult et al, 1996), *H. influenzae* (Fleischmann et al, 1995), *E. coli* (Blattner et al, 1997) and yeast (*S. cerevisiae*) (Mewes et al, 1997) and *D. melanogaster* (Adams et al, 2000). Significant progress has also been made in sequencing the genomes of model organism, such as mouse, *C. elegans* and *Arabadopsis* sp. Several databases containing genomic information annotated with some functional information are maintained by different organizations and maybe accessible via the internet.

One example of a useful algorithm is BLAST and BLAST 2.0 algorithms, which are described in Altschul et al, Nuc. Acids Res. 25:3389-3402, 1977 and Altschul et al, J. Mol. Biol. 215:403-410, 1990, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al, supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T and X determine the sensitivity and speed of the alignment. The BLASTN program (for nucleotide sequences) uses as defaults a wordlength (W) of 11, an expectation (E) of 10, M=5, N=−4 and a comparison of both strands. For amino acid sequences, the BLASTP program uses as defaults a wordlength of 3 and expectations (E) of 10 and the BLOSUM62 scoring matrix (see Henikoff & Henikoff, Proc. Natl. Acad. Sci. USA 89:10915, 1989) alignments (B) of 50, expectation (E) of 10, M=5, N=−4 and a comparison of both strands.

The BLAST algorithm also performs a statistical analysis of the similarity between two sequences (see, e.g., Karlin & Altschul, Proc. Natl. Acad. Sci. USA 90:5873, 1993). One measure of similarity provided by BLAST algorithm is the smallest sum probability (P(N)), which provides an indication of the probability by which a match between two nucleotide or amino acid sequences would occur by chance. For example, a nucleic acid is considered similar to a references sequence if the smallest sum probability in a comparison of the test nucleic acid to the reference nucleic acid is less than about 0.2, more in one aspect less than about 0.01 and most in one aspect less than about 0.001.

In one aspect, protein and nucleic acid sequence homologies are evaluated using the Basic Local Alignment Search Tool ("BLAST") In particular, five specific BLAST programs are used to perform the following task:

(1) BLASTP and BLAST3 compare an amino acid query sequence against a protein sequence database;

(2) BLASTN compares a nucleotide query sequence against a nucleotide sequence database;

(3) BLASTX compares the six-frame conceptual translation products of a query nucleotide sequence (both strands) against a protein sequence database;

(4) TBLASTN compares a query protein sequence against a nucleotide sequence database translated in all six reading frames (both strands); and (5) TBLASTX compares the six-frame translations of a nucleotide query sequence against the six-frame translations of a nucleotide sequence database.

The BLAST programs identify homologous sequences by identifying similar segments, which are referred to herein as "high-scoring segment pairs," between a query amino or nucleic acid sequence and a test sequence which is in one aspect obtained from a protein or nucleic acid sequence database. High-scoring segment pairs are in one aspect identified (i.e., aligned) by means of a scoring matrix, many of which are known in the art. Li one aspect, the scoring matrix used is the BLOSUM62 matrix (Gonnet (1992) Science 256:1443-1445; Henikoff and Henikoff (1993) Proteins 17:49-61). Less in one aspect, the PAM or PAM250 matrices may also be used (see, e.g., Schwartz and Dayhoff, eds., 1978, *Matrices for Detecting Distance Relationships: Atlas of Protein Sequence and Structure*, Washington: National Biomedical Research Foundation). BLAST programs are accessible through the U.S. National Library of Medicine.

The parameters used with the above algorithms may be adapted depending on the sequence length and degree of homology studied. In some aspects, the parameters may be the default parameters used by the algorithms in the absence of instructions from the user.

Computer Systems and Computer Program Products

To determine and identify sequence identities, structural homologies, motifs and the like in silico, a nucleic acid or polypeptide sequence of the invention can be stored, recorded, and manipulated on any medium which can be read and accessed by a computer.

Accordingly, the invention provides computers, computer systems, computer readable mediums, computer programs products and the like recorded or stored thereon the nucleic acid and polypeptide sequences of the invention. As used herein, the words "recorded" and "stored" refer to a process for storing information on a computer medium. A skilled artisan can readily adopt any known methods for recording information on a computer readable medium to generate manufactures comprising one or more of the nucleic acid and/or polypeptide sequences of the invention.

The polypeptides of the invention include the polypeptide sequences of the invention, e.g., the exemplary sequences of the invention, and sequences substantially identical thereto, and fragments of any of the preceding sequences. Substantially identical, or homologous, polypeptide sequences refer to a polypeptide sequence having at least 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity (homology) to an exemplary sequence of the invention.

Homology (sequence identity) maybe determined using any of the computer programs and parameters described herein. A nucleic acid or polypeptide sequence of the invention can be stored, recorded and manipulated on any medium which can be read and accessed by a computer. As used herein, the words "recorded" and "stored" refer to a process for storing information on a computer medium. A skilled artisan can readily adopt any of the presently known methods for recording information on a computer readable medium to generate manufactures comprising one or more of the nucleic acid sequences of the invention, one or more of the polypeptide sequences of the invention. Another aspect of the invention is a computer readable medium having recorded thereon at least 2, 5, 10, 15, or or more nucleic acid or polypeptide sequences of the invention.

Another aspect of the invention is a computer readable medium having recorded thereon one or more of the nucleic acid sequences of the invention. Another aspect of the invention is a computer readable medium having recorded thereon one or more of the polypeptide sequences of the invention. Another aspect of the invention is a computer readable medium having recorded thereon at least 2, 5, 10, 15, or 20 or more of the nucleic acid or polypeptide sequences as set forth above.

Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Aspects of the invention include systems (e.g., internet based systems), particularly computer systems which store and manipulate the sequence information described herein. One example of a computer system 100 is illustrated in block diagram form in FIG. 1. As used herein, "a computer system" refers to the hardware components, software components and data storage components used to analyze a nucleotide sequence of a nucleic acid sequence of the invention, or a polypeptide sequence of the invention. The computer system 100 typically includes a processor for processing, accessing and manipulating the sequence data. The processor 105 can be any well-known type of central processing unit, such as, for example, the Pentium III from Intel Corporation, or similar processor from Sun, Motorola, Compaq, AMD or International Business Machines.

Typically the computer system 100 is a general purpose system that comprises the processor 105 and one or more internal data storage components 110 for storing data and one or more data retrieving devices for retrieving the data stored on the data storage components. A skilled artisan can readily appreciate that any one of the currently available computer systems are suitable.

hi one particular aspect, the computer system 100 includes a processor 105 connected to a bus which is connected to a main memory 115 (in one aspect implemented as RAM) and one or more internal data storage devices 110, such as a hard drive and/or other computer readable media having data recorded thereon. In some aspects, the computer system 100 further includes one or more data retrieving device 118 for reading the data stored on the internal data storage devices 110.

The data retrieving device 118 may represent, for example, a floppy disk drive, a compact disk drive, a magnetic tape drive, or a modem capable of connection to a remote data storage system (e.g., via the internet) etc. In some aspects, the internal data storage device 110 is a removable computer readable medium such as a floppy disk, a compact disk, a magnetic tape, etc. containing control logic and/or data recorded thereon. The computer system 100 may advantageously include or be programmed by appropriate software for reading the control logic and/or the data from the data storage component once inserted in the data retrieving device.

The computer system 100 includes a display 120 which is used to display output to a computer user. It should also be noted that the computer system 100 can be linked to other computer systems 125a-c in a network or wide area network to provide centralized access to the computer system 100.

Software for accessing and processing the nucleotide sequences of a nucleic acid sequence of the invention, or a polypeptide sequence of the invention, (such as search tools, compare tools and modeling tools etc.) may reside in main memory 115 during execution.

hi some aspects, the computer system 100 may further comprise a sequence comparison algorithm for comparing a nucleic acid sequence of the invention, or a polypeptide sequence of the invention, stored on a computer readable medium to a reference nucleotide or polypeptide sequence(s) stored on a computer readable medium. A "sequence comparison algorithm" refers to one or more programs which are implemented (locally or remotely) on the computer system 100 to compare a nucleotide sequence with other nucleotide sequences and/or compounds stored within a data storage means. For example, the sequence comparison algorithm may compare the nucleotide sequences of a nucleic acid sequence of the invention, or a polypeptide sequence of the invention, stored on a computer readable medium to reference sequences stored on a computer readable medium to identify homologies or structural motifs.

Figure 2:
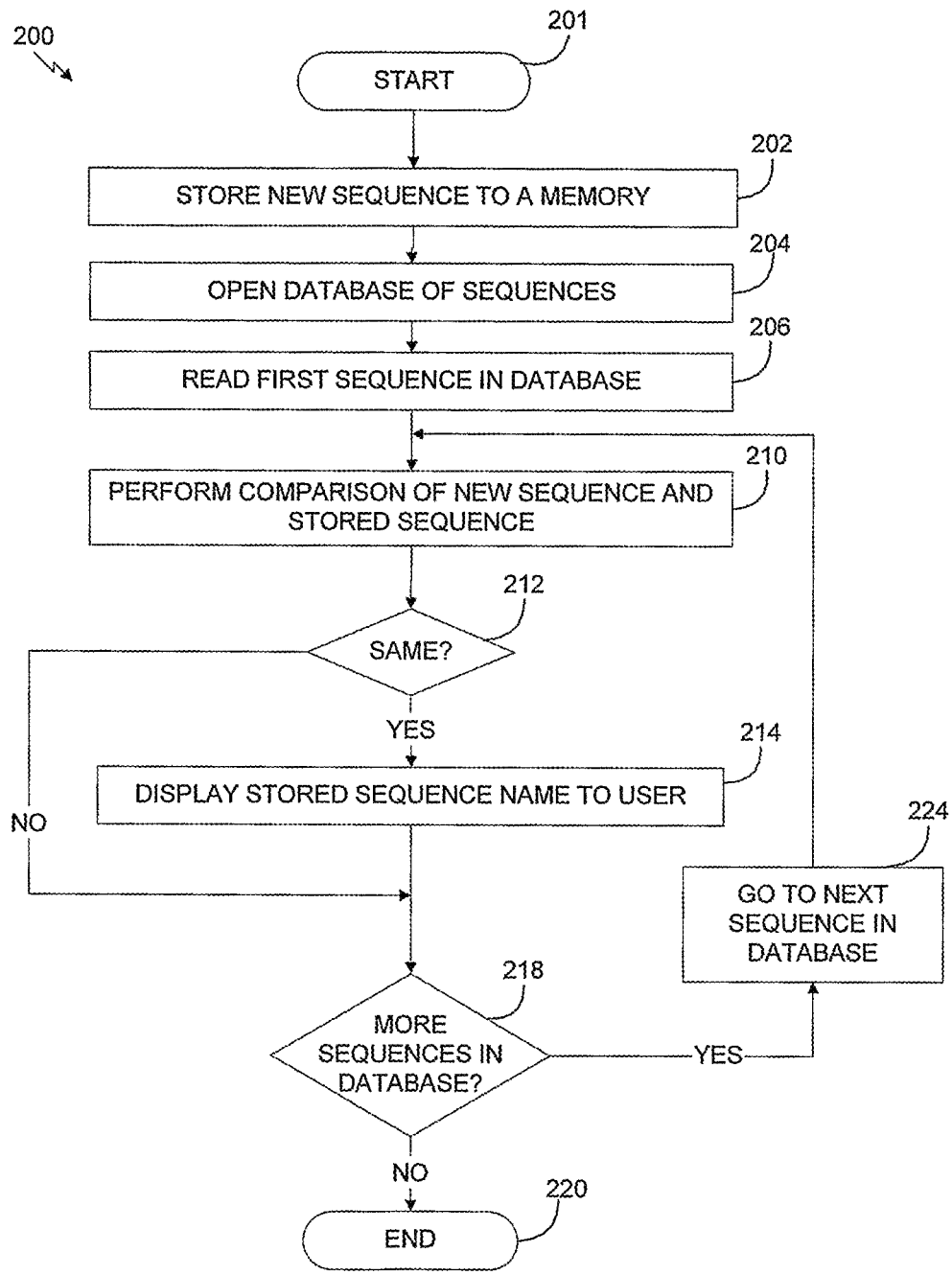
FIG. 2 is a flow diagram illustrating one aspect of a process for comparing a new nucleotide or protein sequence with a database of sequences in order to determine the homology levels between the new sequence and the sequences in the database.

FIG. 2 is a flow diagram illustrating one aspect of a process 200 for comparing a new nucleotide or protein sequence with a database of sequences in order to determine the homology levels between the new sequence and the sequences in the database. The database of sequences can be a private database stored within the computer system 100, or a public database such as GENBANK that is available through the Internet.

The process 200 begins at a start state 201 and then moves to a state 202 wherein the new sequence to be compared is stored to a memory in a computer system 100. As discussed above, the memory could be any type of memory, including RAM or an internal storage device.

The process 200 then moves to a state 204 wherein a database of sequences is opened for analysis and comparison. The process 200 then moves to a state 206 wherein the first sequence stored in the database is read into a memory on the computer. A comparison is then performed at a state 210 to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system.

Once a comparison of the two sequences has been performed at the state 210, a determination is made at a decision state 210 whether the two sequences are the same. Of course, the term "same" is not limited to sequences that are absolutely identical. Sequences that are within the homology parameters entered by the user will be marked as "same" in the process 200.

If a determination is made that the two sequences are the same, the process 200 moves to a state 214 wherein the name of the sequence from the database is displayed to the user. This state notifies the user that the sequence with the displayed name fulfills the homology constraints that were entered. Once the name of the stored sequence is displayed to the user, the process 200 moves to a decision state 218 wherein a determination is made whether more sequences exist in the database. If no more sequences exist in the database, then the process 200 terminates at an end state 220. However, if more sequences do exist in the database, then the process 200 moves to a state 224 wherein a pointer is moved to the next sequence in the database so that it can be compared to the new sequence. In this manner, the new sequence is aligned and compared with every sequence in the database.

It should be noted that if a determination had been made at the decision state 212 that the sequences were not homologous, then the process 200 would move immediately to the decision state 218 in order to determine if any other sequences were available in the database for comparison.

Accordingly, one aspect of the invention is a computer system comprising a processor, a data storage device having stored thereon a nucleic acid sequence of the invention, or a polypeptide sequence of the invention, a data storage device having retrievably stored thereon reference nucleotide sequences or polypeptide sequences to be compared to a nucleic acid sequence of the invention, or a polypeptide sequence of the invention and a sequence comparer for conducting the comparison. The sequence comparer may indicate a homology level between the sequences compared or identify structural motifs in the above described nucleic acid code a nucleic acid sequence of the invention, or a polypeptide sequence of the invention, or it may identify structural motifs in sequences which are compared to these nucleic acid codes and polypeptide codes. In some aspects, the data storage device may have stored thereon the sequences of at least 2, 5, 10, 15, 20, 25, 30 or 40 or more of the nucleic acid sequences of the invention, or the polypeptide sequences of the invention.

Another aspect of the invention is a method for determining the level of homology between a nucleic acid sequence of the invention, or a polypeptide sequence of the invention and a reference nucleotide sequence. The method including reading the nucleic acid code or the polypeptide code and the reference nucleotide or polypeptide sequence through the use of a computer program which determines homology levels and determining homology between the nucleic acid code or polypeptide code and the reference nucleotide or polypeptide sequence with the computer program. The computer program maybe any of a number of computer programs for determining homology levels, including those specifically enumerated herein, (e.g., BLAST2N with the default parameters or with any modified parameters). The method may be implemented using the computer systems described above. The method may also be performed by reading at least 2, 5, 10, 15, 20, 25, or 40 or more of the above described nucleic acid sequences of the invention, or the polypeptide sequences of the invention through use of the computer program and determining homology between the nucleic acid codes or polypeptide codes and reference nucleotide sequences or polypeptide sequences.

Figure 3:
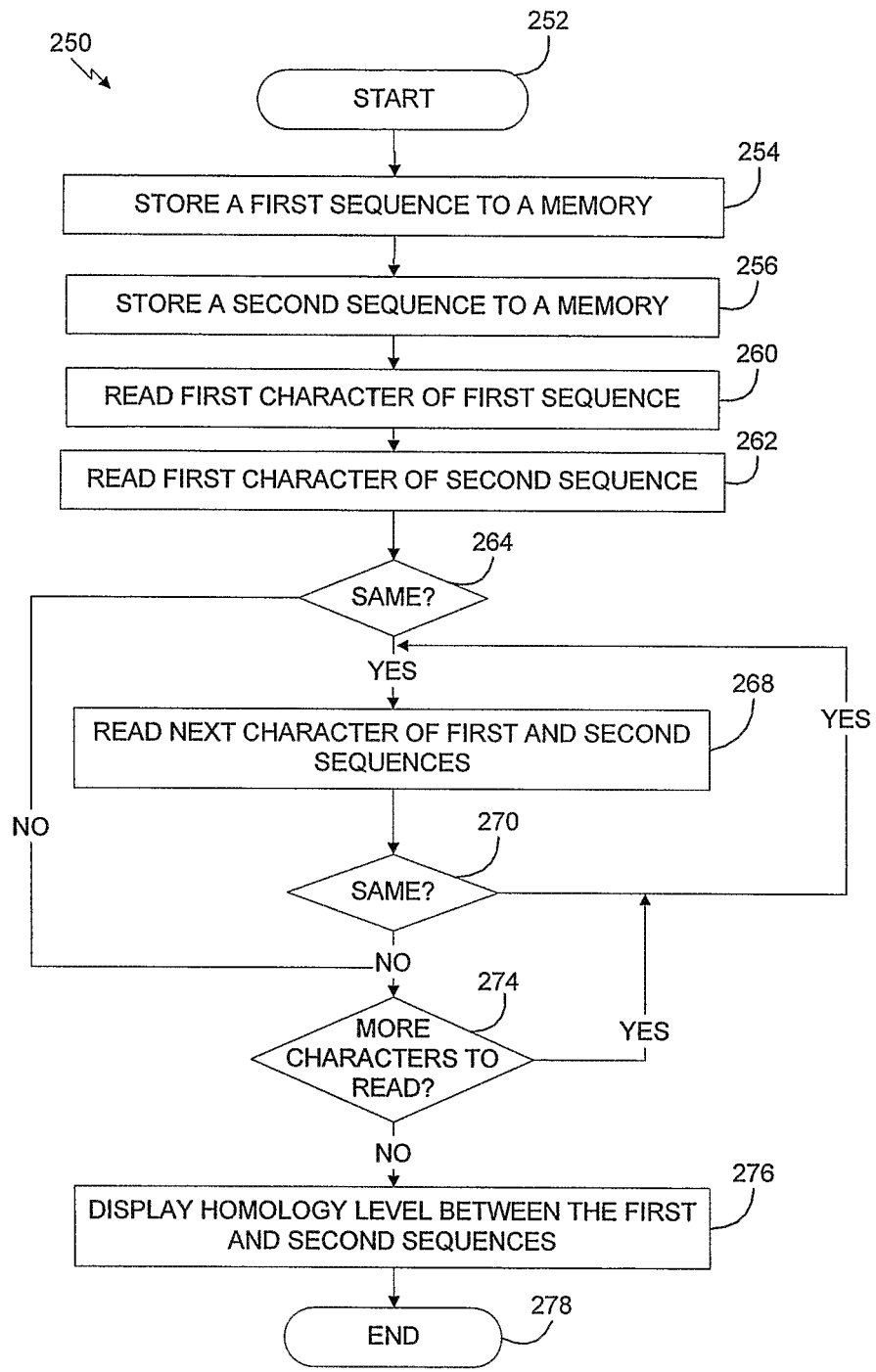
FIG. 3 is a flow diagram illustrating one aspect of a process in a computer for determining whether two sequences are homologous.

FIG. 3 is a flow diagram illustrating one aspect of a process 250 in a computer for determining whether two sequences are homologous. The process 250 begins at a start state 252 and then moves to a state 254 wherein a first sequence to be compared is stored to a memory. The second sequence to be compared is then stored to a memory at a state 256. The process 250 then moves to a state 260 wherein the first character in the first sequence is read and then to a state 262 wherein the first character of the second sequence is read. It should be understood that if the sequence is a nucleotide sequence, then the character would normally be either A, T, C, G or U. If the sequence is a protein sequence, then it is in one aspect in the single letter amino acid code so that the first and sequence sequences can be easily compared.

A determination is then made at a decision state 264 whether the two characters are the same. If they are the same, then the process 250 moves to a state 268 wherein the next characters in the first and second sequences are read. A determination is then made whether the next characters are the same. If they are, then the process 250 continues this loop until two characters are not the same. If a determination is made that the next two characters are not the same, the process 250 moves to a decision state 274 to determine whether there are any more characters either sequence to read.

If there are not any more characters to read, then the process 250 moves to a state 276 wherein the level of homology between the first and second sequences is displayed to the user. The level of homology is determined by calculating the proportion of characters between the sequences that were the same out of the total number of sequences in the first sequence. Thus, if every character in a first 100 nucleotide sequence aligned with a every character in a second sequence, the homology level would be 100%.

Alternatively, the computer program may be a computer program which compares the nucleotide sequences of a nucleic acid sequence as set forth in the invention, to one or more reference nucleotide sequences in order to determine whether the nucleic acid code of the invention, differs from a reference nucleic acid sequence at one or more positions. Optionally such a program records the length and identity of inserted, deleted or substituted nucleotides with respect to the sequence of either the reference polynucleotide or a nucleic acid sequence of the invention. In one aspect, the computer program may be a program which determines whether a nucleic acid sequence of the invention, contains a single nucleotide polymorphism (SNP) with respect to a reference nucleotide sequence.

Accordingly, another aspect of the invention is a method for determining whether a nucleic acid sequence of the invention, differs at one or more nucleotides from a reference nucleotide sequence comprising the steps of reading the nucleic acid code and the reference nucleotide sequence through use of a computer program which identifies differences between nucleic acid sequences and identifying differences between the nucleic acid code and the reference nucleotide sequence with the computer program. In some aspects, the computer program is a program which identifies single nucleotide polymorphisms. The method may be implemented by the computer systems described above and the method illustrated in FIG. 3. The method may also be performed by reading at least 2, 5, 10, 15, 20, 25, 30, or 40 or more of the nucleic acid sequences of the invention and the reference nucleotide sequences through the use of the computer program and identifying differences between the nucleic acid codes and the reference nucleotide sequences with the computer program.

In other aspects the computer based system may further comprise an identifier for identifying features within a nucleic acid sequence of the invention or a polypeptide sequence of the invention.

An "identifier" refers to one or more programs which identifies certain features within a nucleic acid sequence of the invention, or a polypeptide sequence of the invention. In one aspect, the identifier may comprise a program which identifies an open reading frame in a nucleic acid sequence of the invention.

Figure 4:
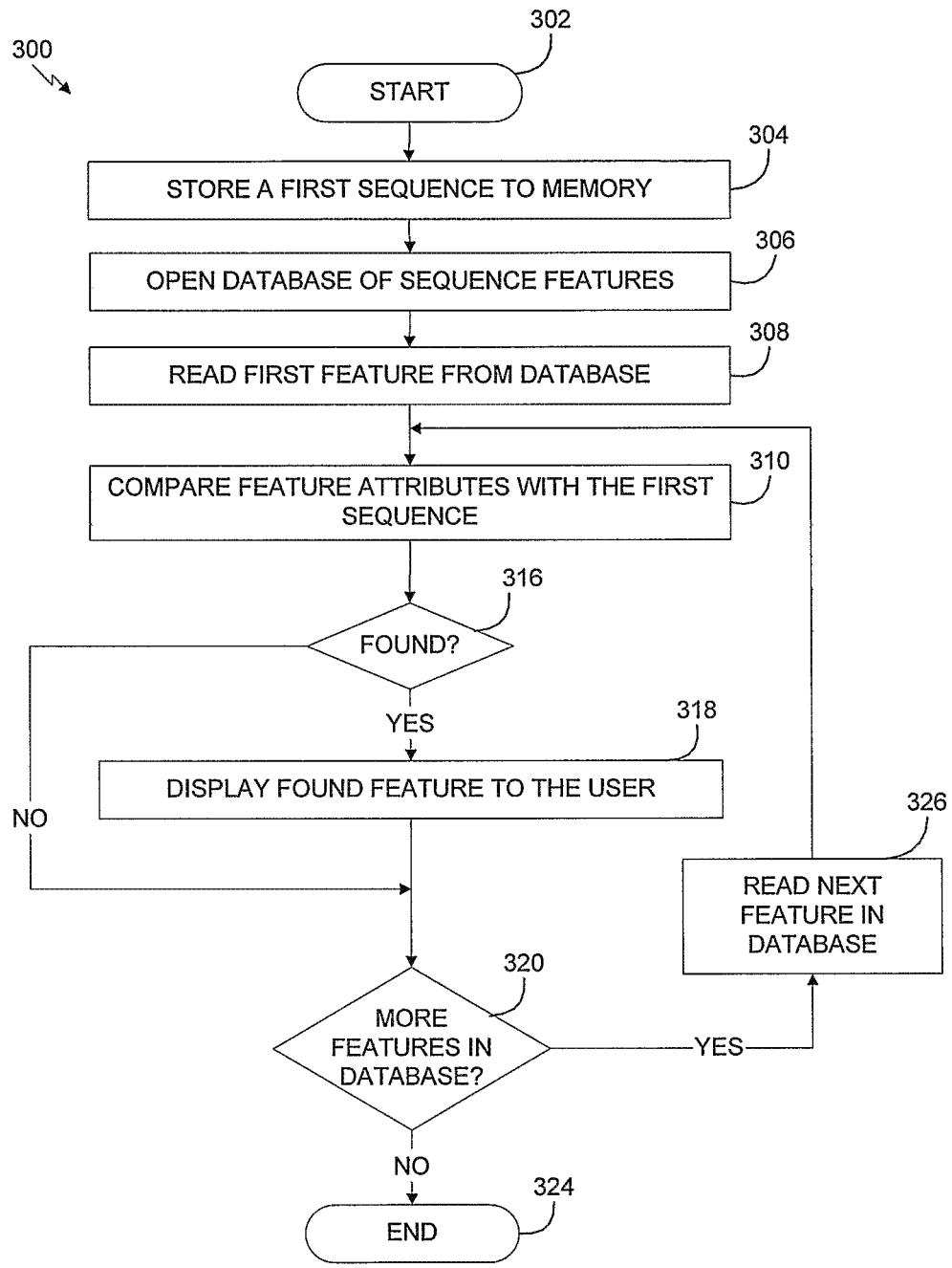
FIG. 4 is a flow diagram illustrating one aspect of an identifier process 300 for detecting the presence of a feature in a sequence.

FIG. 4 is a flow diagram illustrating one aspect of an identifier process 300 for detecting the presence of a feature in a sequence. The process 300 begins at a start state 302 and then moves to a state 304 wherein a first sequence that is to be checked for features is stored to a memory 115 in the computer system 100. The process 300 then moves to a state 306 wherein a database of sequence features is opened. Such a database would include a list of each feature's attributes along with the name of the feature. For example, a feature name could be "Initiation Codon" and the attribute would be "ATG". Another example would be the feature name "TAATAA Box" and the feature attribute would be "TAATAA". An example of such a database is produced by the University of Wisconsin Genetics Computer Group. Alternatively, the features may be structural polypeptide motifs such as alpha helices, beta sheets, or functional polypeptide motifs such as enzymatic active sites, helix-turn-helix motifs or other motifs known to those skilled in the art.

Once the database of features is opened at the state 306, the process 300 moves to a state 308 wherein the first feature is read from the database. A comparison of the attribute of the first feature with the first sequence is then made at a state 310. A determination is then made at a decision state 316 whether the attribute of the feature was found in the first sequence. If the attribute was found, then the process 300 moves to a state 318 wherein the name of the found feature is displayed to the user.

The process 300 then moves to a decision state 320 wherein a determination is made whether move features exist in the database. If no more features do exist, then the process 300 terminates at an end state 324. However, if more features do exist in the database, then the process 300 reads the next sequence feature at a state 326 and loops back to the state 310 wherein the attribute of the next feature is compared against the first sequence. It should be noted, that if the feature attribute is not found in the first sequence at the decision state 316, the process 300 moves directly to the decision state 320 in order to determine if any more features exist in the database.

Accordingly, another aspect of the invention is a method of identifying a feature within a nucleic acid sequence of the invention, or a polypeptide sequence of the invention, comprising reading the nucleic acid code(s) or polypeptide code(s) through the use of a computer program which identifies features therein and identifying features within the nucleic acid code(s) with the computer program. In one aspect, computer program comprises a computer program which identifies open reading frames. The method may be performed by reading a single sequence or at least 2, 5, 10, 15, 20, 25, 30, or 40 of the nucleic acid sequences of the invention, or the polypeptide sequences of the invention, through the use of the computer program and identifying features within the nucleic acid codes or polypeptide codes with the computer program.

A nucleic acid sequence of the invention, or a polypeptide sequence of the invention, may be stored and manipulated in a variety of data processor programs in a variety of formats. For example, a nucleic acid sequence of the invention, or a polypeptide sequence of the invention, may be stored as text in a word processing file, such as Microsoft WORD™ or WORDPERFECT™ or as an ASCII file in a variety of database programs familiar to those of skill in the art, such as DB2™, SYBASE™, or ORACLE™. In addition, many computer programs and databases may be used as sequence comparison algorithms, identifiers, or sources of reference nucleotide sequences or polypeptide sequences to be compared to a nucleic acid sequence of the invention, or a polypeptide sequence of the invention. The following list is intended not to limit the invention but to provide guidance to programs and databases which are useful with the nucleic acid sequences of the invention, or the polypeptide sequences of the invention.

The programs and databases which may be used include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al, J. Mol. Biol. 215: 403, 1990), FASTA (Pearson and Lipman, Proc. Natl. Acad. Sci. USA, 85: 2444, 1988), FASTDB (Brutlag et al. Comp. App. Biosci. 6:237-245, 1990), Catalyst (Molecular Simulations Inc.), Catalyst/SHAPE (Molecular Simulations Inc.), Cerius$^2$.DBAccess (Molecular Simulations Inc.), HypoGen (Molecular Simulations Inc.), Insight II, (Molecular Simulations Inc.), Discover (Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the MDL Available Chemicals Directory database, the MDL Drug Data Report data base, the Comprehensive Medicinal Chemistry database, Derwents's World Drug Index database, the BioByteMasterFile database, the Genbank database and the Genseqn database. Many other programs and data bases would be apparent to one of skill in the art given the present disclosure.

Motifs which may be detected using the above programs include sequences encoding leucine zippers, helix-turn-helix motifs, glycosylation sites, ubiquitination sites, alpha helices and beta sheets, signal sequences encoding signal peptides which direct the secretion of the encoded proteins, sequences implicated in transcription regulation such as homeoboxes, acidic stretches, enzymatic active sites, substrate binding sites and enzymatic cleavage sites.

Hybridization of Nucleic Acids

The invention provides isolated, synthetic or recombinant nucleic acids that hybridize under stringent conditions to a sequence of the invention, including any exemplary sequence of the invention (e.g., including all odd SEQ ID NO:s between SEQ ID NO:1 and SEQ ID NO:251). The stringent conditions can be highly stringent conditions, medium stringent conditions and/or low stringent conditions, including the high and reduced stringency conditions described herein. In one aspect, it is the stringency of the wash conditions that set forth the conditions which determine whether a nucleic acid is within the scope of the invention, as discussed below.

"Hybridization" refers to the process by which a nucleic acid strand joins with a complementary strand through base pairing. Hybridization reactions can be sensitive and selective so that a particular sequence of interest can be identified even in samples in which it is present at low concentrations. Suitably stringent conditions can be defined by, for example, the concentrations of salt or formamide in the prehybridization and hybridization solutions, or by the hybridization temperature and are well known in the art. In particular, stringency can be increased by reducing the concentration of salt, increasing the concentration of formamide, or raising the hybridization temperature. In alternative aspects, nucleic acids of the invention are defined by their ability to hybridize under various stringency conditions (e.g., high, medium, and low), as set forth herein.

For example, hybridization under high stringency conditions could occur in about 50% formamide at about 37° C. to 42° C. Hybridization could occur under reduced stringency conditions in about 35% to 25% formamide at about 30° C. to 35° C. In one aspect, hybridization occurs under high stringency conditions, e.g., at 42° C. in 50% formamide, 5×SSPE, 0.3% SDS and 200 n/ml sheared and denatured salmon sperm DNA. Hybridization could occur under these reduced stringency conditions, but in 35% formamide at a reduced temperature of 35° C. The temperature range corresponding to a particular level of stringency can be further narrowed by calculating the purine to pyrimidine ratio of the nucleic acid of interest and adjusting the temperature accordingly. Variations on the above ranges and conditions are well known in the art.

In alternative aspects, nucleic acids of the invention as defined by their ability to hybridize under stringent conditions can be between about five residues and the full length of nucleic acid of the invention; e.g., they can be at least 5, 10, 15, 20, 25, 30, 35, 40, 50, 55, 60, 65, 70, 75, 80, 90, 100, 150, 200, 250, 300, 350, 400, 450, 500, 550, 600, 650, 700, 750, 800, 850, 900, 950, 1000, or more, residues in length. Nucleic acids shorter than full length are also included. These nucleic acids can be useful as, e.g., hybridization probes, labeling probes, PCR oligonucleotide probes, iRNA (siRNA or miRNA, single or double stranded), antisense or sequences encoding antibody binding peptides (epitopes), motifs, active sites and the like.

In one aspect, nucleic acids of the invention are defined by their ability to hybridize under high stringency comprises conditions of about 50% formamide at about 37° C. to 42° C. In one aspect, nucleic acids of the invention are defined by their ability to hybridize under reduced stringency comprising conditions in about 35% to 25% formamide at about 30° C. to 35° C.

Alternatively, nucleic acids of the invention are defined by their ability to hybridize under high stringency comprising conditions at 42° C. in 50% formamide, 5×SSPE, 0.3% SDS, and a repetitive sequence blocking nucleic acid, such as cot-1 or salmon sperm DNA (e.g., 200 µg/ml sheared and denatured salmon sperm DNA). In one aspect, nucleic acids of the invention are defined by their ability to hybridize under reduced stringency conditions comprising 35% formamide at a reduced temperature of 35° C.

In nucleic acid hybridization reactions, the conditions used to achieve a particular level of stringency will vary, depending on the nature of the nucleic acids being hybridized. For example, the length, degree of complementarity, nucleotide sequence composition (e.g., GC v. AT content) and nucleic acid type (e.g., RNA v. DNA) of the hybridizing regions of the nucleic acids can be considered in selecting hybridization conditions. An additional consideration is whether one of the nucleic acids is immobilized, for example, on a filter.

Hybridization maybe carried out under conditions of low stringency, moderate stringency or high stringency. As an example of nucleic acid hybridization, a polymer membrane containing immobilized denatured nucleic acids is first prehybridized for 30 minutes at 45° C. in a solution consisting of 0.9 M NaCl, 50 mM NaH$_2$PO$_4$, pH 7.0, 5.0 mM Na$_2$EDTA, 0.5% SDS, 10×Denhardt's and 0.5 mg/ml polyriboadenylic acid. Approximately 2×10$^7$ cpm (specific activity 4–9×10$^8$ cpm/ug) Of $^{32}$P end-labeled oligonucleotide probe are then added to the solution. After 12-16 hours of incubation, the membrane is washed for 30 minutes at room temperature in 1×SET (150 mM NaCl, 20 mM Tris hydrochloride, pH 7.8, 1 mM Na$_2$EDTA) containing 0.5% SDS, followed by a 30 minute wash in fresh 1×SET at T$_{1n}$-10° C. for the oligonucleotide probe. The membrane is then exposed to autoradiographic film for detection of hybridization signals.

All of the foregoing hybridizations would be considered to be under conditions of high stringency.

Following hybridization, a filter can be washed to remove any non-specifically bound detectable probe. The stringency used to wash the filters can also be varied depending on the nature of the nucleic acids being hybridized, the length of the nucleic acids being hybridized, the degree of complementarity, the nucleotide sequence composition (e.g., GC v. AT content) and the nucleic acid type (e.g., RNA v. DNA). Examples of progressively higher stringency condition washes are as follows: 2×SSC, 0.1% SDS at room temperature for 15 minutes (low stringency); 0.1×SSC, 0.5% SDS at room temperature for 30 minutes to 1 hour (moderate stringency); 0.1×SSC, 0.5% SDS for 15 to 30 minutes at between the hybridization temperature and 68° C. (high stringency); and 0.15M NaCl for 15 minutes at 72° C. (very high stringency). A final low stringency wash can be conducted in 0.1×SSC at room temperature. The examples above are merely illustrative of one set of conditions that can be used to wash filters. One of skill in the art would know that there are numerous recipes for different stringency washes. Some other examples are given below.

In one aspect, hybridization conditions comprise a wash step comprising a wash for 30 minutes at room temperature in a solution comprising 1×150 mM NaCl, 20 mM Tris hydrochloride, pH 7.8, 1 mM N EDTA, 0.5% SDS, followed by a 30 minute wash in fresh solution.

Nucleic acids which have hybridized to the probe are identified by autoradiography or other conventional techniques.

The above procedure may be modified to identify nucleic acids having decreasing levels of homology to the probe sequence. For example, to obtain nucleic acids of decreasing homology to the detectable probe, less stringent conditions may be used. For example, the hybridization temperature maybe decreased in increments of 5° C. from 68° C. to 42° C. in a hybridization buffer having a $Na^+$ concentration of approximately 1 M. Following hybridization, the filter may be washed with 2×SSC, 0.5% SDS at the temperature of hybridization. These conditions are considered to be "moderate" conditions above 50° C. and "low" conditions below 50° C. A specific example of "moderate" hybridization conditions is when the above hybridization is conducted at 55° C. A specific example of "low stringency" hybridization conditions is when the above hybridization is conducted at 45° C.

Alternatively, the hybridization maybe carried out in buffers, such as 6×SSC, containing formamide at a temperature of 42° C. In this case, the concentration of formamide in the hybridization buffer may be reduced in 5% increments from 50% to 0% to identify clones having decreasing levels of homology to the probe. Following hybridization, the filter may be washed with 6×SSC, 0.5% SDS at 50° C. These conditions are considered to be "moderate" conditions above 25% formamide and "low" conditions below 25% formamide. A specific example of "moderate" hybridization conditions is when the above hybridization is conducted at 30% formamide. A specific example of "low stringency" hybridization conditions is when the above hybridization is conducted at 10% formamide.

However, the selection of a hybridization format is not critical—it is the stringency of the wash conditions that set forth the conditions which determine whether a nucleic acid is within the scope of the invention. Wash conditions used to identify nucleic acids within the scope of the invention include, e.g.: a salt concentration of about 0.02 molar at pH 7 and a temperature of at least about 50° C. or about 55° C. to about 60° C.; or, a salt concentration of about 0.15 M NaCl at 72° C. for about 15 minutes; or, a salt concentration of about 0.2×SSC at a temperature of at least about 50° C. or about 55° C. to about 60° C. for about 15 to about 20 minutes; or, the hybridization complex is washed twice with a solution with a salt concentration of about 2×SSC containing 0.1% SDS at room temperature for 15 minutes and then washed twice by 0.1×SSC containing 0.1%

SDS at 68° C. for 15 minutes; or, equivalent conditions. See Sambrook, Tijssen and Ausubel for a description of SSC buffer and equivalent conditions.

These methods may be used to isolate nucleic acids of the invention. For example, the preceding methods may be used to isolate nucleic acids having a sequence with at least about 97%, at least 95%, at least 90%, at least 85%, at least 80%, at least 75%, at least 70%, at least 65%, at least 60%, at least 55%, or at least 50% sequence identity (homology) to a nucleic acid sequence selected from the group consisting of one of the sequences of the invention, or fragments comprising at least about 10, 15, 20, 25, 30, 35, 40, 50, 75, 100, 150, 200, 300, 400, or 500 consecutive bases thereof and the sequences complementary thereto. Sequence identity (homology) may be measured using the alignment algorithm. For example, the homologous polynucleotides may have a coding sequence which is a naturally occurring allelic variant of one of the coding sequences described herein. Such allelic variants may have a substitution, deletion or addition of one or more nucleotides when compared to the nucleic acids of the invention. Additionally, the above procedures may be used to isolate nucleic acids which encode polypeptides having at least about 99%, 95%, at least 90%, at least 85%, at least 80%, at least 75%, at least 70%, at least 65%, at least 60%, at least 55%, or at least 50% sequence identity (homology) to a polypeptide of the invention, or fragments comprising at least 5, 10, 15, 20, 25, 30, 35, 40, 50, 75, 100, or 150 consecutive amino acids thereof as determined using a sequence alignment algorithm (e.g., such as the FASTA version 3.0t78 algorithm with the default parameters).

Oligonucleotides Probes and Methods for Using them

The invention also provides nucleic acid probes that can be used, e.g., for identifying nucleic acids encoding a polypeptide with an ammonia lyase, e.g., phenylalanine ammonia lyase, tyrosine ammonia lyase and/or histidine ammonia lyase enzyme activity or fragments thereof or for identifying ammonia lyase, e.g., phenylalanine ammonia lyase, tyrosine ammonia lyase and/or histidine ammonia lyase enzyme genes. In one aspect, the probe comprises at least 10 consecutive bases of a nucleic acid of the invention. Alternatively, a probe of the invention can be at least about 5, 6, 7, 8, 9, 10, 11, 12, 13, 14, 15, 16, 17, 18, 19, 20, 21, 22, 23, 24, 25, 30, 35, 40, 45, 50, 60, 70, 80, 90, 100, 110, 120, 130, 150 or about 10 to 50, about 20 to 60 about 30 to 70, consecutive bases of a sequence as set forth in a nucleic acid of the invention. The probes identify a nucleic acid by binding and/or hybridization. The probes can be used in arrays of the invention, see discussion below, including, e.g., capillary arrays. The probes of the invention can also be used to isolate other nucleic acids or polypeptides.

The isolated nucleic acids of the invention, the sequences complementary thereto, or a fragment comprising at least 10, 15, 20, 25, 30, 35, 40, 50, 75, 100, 150, 200, 300, 400, or 500 consecutive bases of one of the sequences of the invention, or the sequences complementary thereto may also be used as probes to determine whether a biological sample, such as a soil sample, contains an organism having a nucleic acid sequence of the invention or an organism from which the nucleic acid was obtained. In such procedures, a biological sample potentially harboring the organism from which the nucleic acid was isolated is obtained and nucleic acids are obtained from the sample. The nucleic acids are contacted with the probe under conditions which permit the probe to specifically hybridize to any complementary sequences from which are present therein.

Where necessary, conditions which permit the probe to specifically hybridize to complementary sequences may be determined by placing the probe in contact with complementary sequences from samples known to contain the complementary sequence as well as control sequences which do not contain the complementary sequence. Hybridization conditions, such as the salt concentration of the hybridization buffer, the formamide concentration of the hybridization buffer, or the hybridization temperature, may be varied to identify conditions which allow the probe to hybridize specifically to complementary nucleic acids.

If the sample contains the organism from which the nucleic acid was isolated, specific hybridization of the probe is then detected. Hybridization may be detected by labeling the probe with a detectable agent such as a radioactive isotope, a fluorescent dye or an enzyme capable of catalyzing the formation of a detectable product.

Many methods for using the labeled probes to detect the presence of complementary nucleic acids in a sample are familiar to those skilled in the art. These include Southern Blots, Northern Blots, colony hybridization procedures and dot blots. Protocols for each of these procedures are provided in Ausubel et al. Current Protocols in Molecular Biology, John Wiley 503 Sons, Inc. (1997) and Sambrook et al., Molecular Cloning: A Laboratory Manual 2nd Ed., Cold Spring Harbor Laboratory Press (1989.

Alternatively, more than one probe (at least one of which is capable of specifically hybridizing to any complementary sequences which are present in the nucleic acid sample), may be used in an amplification reaction to determine whether the sample contains an organism containing a nucleic acid sequence of the invention (e.g., an organism from which the nucleic acid was isolated). Typically, the probes comprise oligonucleotides. In one aspect, the amplification reaction may comprise a PCR reaction. PCR protocols are described in Ausubel and Sambrook, supra. Alternatively, the amplification may comprise a ligase chain reaction, 3SR, or strand displacement reaction. (See Barany, F., "The Ligase Chain Reaction in a PCR World", *PCR Methods and Applications* 1:5-16, 1991; E. Fahy et ah, "Self-sustained Sequence Replication (3SR): An Isothermal Transcription-based Amplification System Alternative to PCR", *PCR Methods and Applications* 1:25-33, 1991; and Walker G. T. et al, "Strand Displacement Amplification-an Isothermal in vitro DNA Amplification Technique", *Nucleic Acid Research* 20: 1691-1696, 1992). In such procedures, the nucleic acids in the sample are contacted with the probes, the amplification reaction is performed and any resulting amplification product is detected. The amplification product may be detected by performing gel electrophoresis on the reaction products and staining the gel with an intercalator such as ethidium bromide. Alternatively, one or more of the probes may be labeled with a radioactive isotope and the presence of a radioactive amplification product may be detected by autoradiography after gel electrophoresis.

Probes derived from sequences near the ends of the sequences of the invention, may also be used in chromosome walking procedures to identify clones containing genomic sequences located adjacent to the sequences of the invention. Such methods allow the isolation of genes which encode additional proteins from the host organism.

The isolated nucleic acids of the invention, the sequences complementary thereto, or a fragment comprising at least 10, 15, 20, 25, 30, 35, 40, 50, 75, 100, 150, 200, 300, 400, or 500 consecutive bases of one of the sequences of the invention, or the sequences complementary thereto may be used as probes to identify and isolate related nucleic acids. In some aspects, the related nucleic acids may be cDNAs or genomic DNAs from organisms other than the one from which the nucleic acid was isolated. For example, the other organisms may be related organisms. In such procedures, a nucleic acid sample is contacted with the probe under conditions which permit the probe to specifically hybridize to related sequences. Hybridization of the probe to nucleic acids from the related organism is then detected using any of the methods described above.

By varying the stringency of the hybridization conditions used to identify nucleic acids, such as cDNAs or genomic DNAs, which hybridize to the detectable probe, nucleic acids having different levels of homology to the probe can be identified and isolated. Stringency may be varied by conducting the hybridization at varying temperatures below the melting temperatures of the probes. The melting temperature, $T_m$, is the temperature (under defined ionic strength and pH) at which 50% of the target sequence hybridizes to a perfectly complementary probe. Very stringent conditions are selected to be equal to or about 5° C. lower than the $T_m$ for a particular probe. The melting temperature of the probe may be calculated using the following formulas:

For probes between 14 and 70 nucleotides in length the melting temperature ($T_m$) is calculated using the formula: $T_m=81.5+16.6(\text{tog}[Na^+])+0.41(\text{fraction } G+C)-(600/N)$ where N is the length of the probe.

If the hybridization is carried out in a solution containing formamide, the melting temperature maybe calculated using the equation: $T_m=81.5+16.6(\log [Na^+])+0.41 (\text{fraction } G+C)-(0.63\% \text{ formamide})-(600/N)$ where N is the length of the probe.

Prehybridization maybe carried out in 6×SSC, 5×Denhardt's reagent, 0.5% SDS, 100 µg/ml denatured fragmented salmon sperm DNA or 6×SSC, 5×Denhardt's reagent, 0.5% SDS, 100 µg/ml denatured fragmented salmon sperm DNA, 50% formamide. The formulas for SSC and Denhardt's solutions are listed in Sambrook et ah, supra.

Hybridization is conducted by adding the detectable probe to the prehybridization solutions listed above. Where the probe comprises double stranded DNA, it is denatured before addition to the hybridization solution. The filter is contacted with the hybridization solution for a sufficient period of time to allow the probe to hybridize to cDNAs or genomic DNAs containing sequences complementary thereto or homologous thereto. For probes over 200 nucleotides in length, the hybridization may be carried out at 15-25° C. below the $T_h$. For shorter probes, such as oligonucleotide probes, the hybridization may be conducted at 5-10° C. below the $T_m$. In one aspect, for hybridizations in 6×SSC, the hybridization is conducted at approximately 68° C. Usually, for hybridizations in 50% formamide containing solutions, the hybridization is conducted at approximately 42° C.

Inhibiting Expression of Ammonia Lyase, e.g., Phenylalanine Ammonia Lyase, Tyrosine Ammonia Lyase and/or Histidine Ammonia Lyase Enzymes The invention provides nucleic acids complementary to (e.g., antisense sequences to) the nucleic acids of the invention, e.g., ammonia lyase enzyme-encoding nucleic acids, e.g., nucleic acids comprising antisense, iRNA, ribozymes. Nucleic acids of the invention comprising antisense sequences can be capable of inhibiting the transport, splicing or transcription of ammonia lyase enzyme-encoding genes. The inhibition can be effected through the targeting of genomic DNA or messenger RNA. The transcription or function of targeted nucleic acid can be inhibited, for example, by hybridization and/or cleavage. One particularly useful set of inhibitors provided by the present invention includes oligonucleotides which are able to either bind ammonia lyase, e.g., phenylalanine ammonia lyase, tyrosine ammonia lyase and/or histidine ammonia lyase enzyme gene or message, in either case preventing or inhibiting the production or function of an ammonia lyase, e.g., phenylalanine ammonia lyase, tyrosine ammonia lyase and/or histidine ammonia lyase enzyme. The association can be through sequence specific hybridization. Another useful class of inhibitors includes oligonucleotides which cause inactivation or cleavage of ammonia lyase, e.g., phenylalanine ammonia lyase, tyrosine ammonia lyase and/or histidine ammonia lyase enzyme message. The oligonucleotide can have enzyme activity which causes such cleavage, such as ribozymes. The oligonucleotide can be chemically modified or conjugated to an enzyme or composition capable of cleaving the complementary nucleic acid. A pool of many different such oligonucleotides can be screened for those with the desired activity. Thus, the invention provides various compositions for the inhibition of ammonia lyase, e.g., phenylalanine ammonia lyase, tyrosine ammonia lyase and/or histidine ammonia lyase enzyme expression on a nucleic acid and/or protein level, e.g., antisense, iRNA (e.g., siRNA, miRNA) and ribozymes comprising ammonia lyase, e.g., phenylalanine ammonia lyase, tyrosine ammonia lyase and/or histidine ammonia lyase enzyme sequences of the invention and the anti-ammonia lyase, e.g., anti-phenylalanine ammonia lyase, anti-tyrosine ammonia lyase and/or anti-histidine ammonia lyase enzyme antibodies of the invention.

Inhibition of ammonia lyase, e.g., phenylalanine ammonia lyase, tyrosine ammonia lyase and/or histidine ammonia lyase enzyme expression can have a variety of industrial applications. For example, inhibition of ammonia lyase, e.g., phenylalanine ammonia lyase, tyrosine ammonia lyase and/or histidine ammonia lyase enzyme expression can slow or prevent spoilage. In one aspect, use of compositions of the invention that inhibit the expression and/or activity of ammonia lyase, e.g., phenylalanine ammonia lyase, tyrosine ammonia lyase and/or histidine ammonia lyase enzymes, e.g., antibodies, antisense oligonucleotides, ribozymes and RNAi, are used to slow or prevent spoilage. Thus, in one aspect, the invention provides methods and compositions comprising application onto a plant or plant product (e.g., a cereal, a grain, a fruit, seed, root, leaf, etc.) antibodies, antisense oligonucleotides, ribozymes and RNAi of the invention to slow or prevent spoilage. These compositions also can be expressed by the plant (e.g., a transgenic plant) or another organism (e.g., a bacterium or other microorganism transformed with an ammonia lyase, e.g., phenylalanine ammonia lyase, tyrosine ammonia lyase and/or histidine ammonia lyase enzyme gene of the invention).

The compositions of the invention for the inhibition of ammonia lyase, e.g., phenylalanine ammonia lyase, tyrosine ammonia lyase and/or histidine ammonia lyase enzyme expression (e.g., antisense, iRNA, ribozymes, antibodies) can be used as pharmaceutical compositions, e.g., as anti-pathogen agents or in other therapies, e.g., as anti-microbials for, e.g., *Salmonella*.

Antisense Oligonucleotides

The invention provides antisense oligonucleotides capable of binding ammonia lyase, e.g., phenylalanine ammonia lyase, tyrosine ammonia lyase and/or histidine ammonia lyase enzyme message which, in one aspect, can inhibit ammonia lyase, e.g., phenylalanine ammonia lyase, tyrosine ammonia lyase and/or histidine ammonia lyase enzyme activity by targeting mRNA. Strategies for designing antisense oligonucleotides are well described in the scientific and patent literature, and the skilled artisan can design such ammonia lyase, e.g., phenylalanine ammonia lyase, tyrosine ammonia lyase and/or histidine ammonia lyase enzyme oligonucleotides using the novel reagents of the invention. For example, gene walking/RNA mapping protocols to screen for effective antisense oligonucleotides are well known in the art, see, e.g., Ho (2000) Methods Enzymol. 314:168-183, describing an RNA mapping assay, which is based on standard molecular techniques to provide an easy and reliable method for potent antisense sequence selection. See also Smith (2000) Eur. J. Pharm. Sci. 11:191-198.

Naturally occurring nucleic acids are used as antisense oligonucleotides. The antisense oligonucleotides can be of any length; for example, in alternative aspects, the antisense oligonucleotides are between about 5 to 100, about 10 to 80, about 15 to 60, about 18 to 40. The optimal length can be determined by routine screening. The antisense oligonucleotides can be present at any concentration. The optimal concentration can be determined by routine screening. A wide variety of synthetic, non-naturally occurring nucleotide and nucleic acid analogues are known which can address this potential problem. For example, peptide nucleic acids (PNAs) containing non-ionic backbones, such as N-(2-aminoethyl) glycine units can be used. Antisense oligonucleotides having phosphorothioate linkages can also be used, as described in WO 97/03211; WO 96/39154; Mata (1997) Toxicol Appl Pharmacol 144:189-197; Antisense Therapeutics, ed. Agrawal (Humana Press, Totowa, N.J., 1996). Antisense oligonucleotides having synthetic DNA backbone analogues provided by the invention can also include phosphorodithioate, methylphosphonate, phosphoramidate, alkyl phosphotriester, sulfamate, 3'-thioacetal, methylene(methylimino), 3'-N-carbamate, and morpholino carbamate nucleic acids, as described above.

Combinatorial chemistry methodology can be used to create vast numbers of oligonucleotides that can be rapidly screened for specific oligonucleotides that have appropriate binding affinities and specificities toward any target, such as the sense and antisense ammonia lyase, e.g., phenylalanine ammonia lyase, tyrosine ammonia lyase and/or histidine ammonia lyase enzyme sequences of the invention (see, e.g., Gold (1995) J. of Biol. Chem. 270:13581-13584).

Inhibitory Ribozymes

The invention provides ribozymes capable of binding ammonia lyase, e.g., phenylalanine ammonia lyase, tyrosine ammonia lyase and/or histidine ammonia lyase enzyme message. These ribozymes can inhibit ammonia lyase, e.g., phenylalanine ammonia lyase, tyrosine ammonia lyase and/or histidine ammonia lyase enzyme activity by, e.g., targeting mRNA. Strategies for designing ribozymes and selecting the ammonia lyase, e.g., phenylalanine ammonia lyase, tyrosine ammonia lyase and/or histidine ammonia lyase enzyme-specific antisense sequence for targeting are well described in the scientific and patent literature, and the skilled artisan can design such ribozymes using the novel reagents of the invention. Ribozymes act by binding to a target RNA through the target RNA binding portion of a ribozyme which is held in close proximity to an enzymatic portion of the RNA that cleaves the target RNA. Thus, the ribozyme recognizes and binds a target RNA through complementary base-pairing, and once bound to the correct site, acts enzymatically to cleave and inactivate the target RNA. Cleavage of a target RNA in such a manner will destroy its ability to direct synthesis of an encoded protein if the cleavage occurs in the coding sequence. After a ribozyme has bound and cleaved its RNA target, it can be released from that RNA to bind and cleave new targets repeatedly.

In some circumstances, the enzymatic nature of a ribozyme can be advantageous over other technologies, such as antisense technology (where a nucleic acid molecule simply binds to a nucleic acid target to block its transcription, translation or association with another molecule) as the effective concentration of ribozyme necessary to effect a therapeutic treatment can be lower than that of an antisense oligonucleotide. This potential advantage reflects the ability of the ribozyme to act enzymatically. Thus, a single ribozyme molecule is able to cleave many molecules of target RNA. In addition, a ribozyme is typically a highly specific inhibitor, with the specificity of inhibition depending not only on the base pairing mechanism of binding, but also on the mechanism by which the molecule inhibits the expression of the RNA to which it binds. That is, the inhibition is caused by cleavage of the RNA target and so specificity is defined as the ratio of the rate of cleavage of the targeted RNA over the rate of cleavage of non-targeted RNA. This cleavage mechanism is dependent upon factors additional to those involved in base pairing. Thus, the specificity of action of a ribozyme can be greater than that of antisense oligonucleotide binding the same RNA site.

The ribozyme of the invention, e.g., an enzymatic ribozyme RNA molecule, can be formed in a hammerhead motif, a hairpin motif, as a hepatitis delta virus motif, a group I intron motif and/or an RNaseP-like RNA in association with an RNA guide sequence. Examples of hammerhead motifs are described by, e.g., Rossi (1992) Aids Research and Human Retroviruses 8:183; hairpin motifs by Hampel (1989) Biochemistry 28:4929, and Hampel (1990) Nuc. Acids Res. 18:299; the hepatitis delta virus motif by Perrotta (1992) Biochemistry 3 1:16; the RNaseP motif by Guerrier-Takada (1983) Cell 35:849; and the group I intron by Cech U.S. Pat. No. 4,987,071. The recitation of these specific motifs is not intended to be limiting. Those skilled in the art will recognize that a ribozyme of the invention, e.g., an enzymatic RNA molecule of this invention, can have a specific substrate binding site complementary to one or more of the target gene RNA regions. A ribozyme of the invention can have a nucleotide sequence within or surrounding that substrate binding site which imparts an RNA cleaving activity to the molecule.

RNA Interference (RNAi)

In one aspect, the invention provides an RNA inhibitory molecule, a so-called "RNAi" molecule, comprising an ammonia lyase, e.g., phenylalanine ammonia lyase, tyrosine ammonia lyase and/or histidine ammonia lyase enzyme sequence of the invention. The RNAi molecule comprises a double-stranded RNA (dsRNA) molecule. The RNAi molecule, e.g., siRNA and/or miRNA, can inhibit expression of an ammonia lyase, e.g., phenylalanine ammonia lyase, tyrosine ammonia lyase and/or histidine ammonia lyase enzyme gene. In one aspect, the RNAi molecule, e.g., siRNA and/or miRNA, is about 15, 16, 17, 18, 19, 20, 21, 22, 23, 24, 25 or more duplex nucleotides in length.

While the invention is not limited by any particular mechanism of action, the RNAi can enter a cell and cause the degradation of a single-stranded RNA (ssRNA) of similar or identical sequences, including endogenous mRNAs. When a cell is exposed to double-stranded RNA (dsRNA), mRNA from the homologous gene is selectively degraded by a process called RNA interference (RNAi). A possible basic mechanism behind RNAi is the breaking of a double-stranded RNA (dsRNA) matching a specific gene sequence into short pieces called short interfering RNA, which trigger the degradation of mRNA that matches its sequence. In one aspect, the RNAi's of the invention are used in gene-silencing therapeutics, see, e.g., Shuey (2002) Drug Discov. Today 7:1040-1046. In one aspect, the invention provides methods to selectively degrade RNA using the RNAi's molecules, e.g., siRNA and/or miRNA, of the invention. In one aspect, the micro-inhibitory RNA (miRNA) inhibits translation, and the siRNA inhibits transcription. The process may be practiced in vitro, ex vivo or in vivo. In one aspect, the RNAi molecules of the invention can be used to generate a loss-of-function mutation in a cell, an organ or an animal. Methods for making and using RNAi molecules, e.g., siRNA and/or miRNA, for selectively degrade RNA are well known in the art, see, e.g., U.S. Pat. Nos. 6,506,559; 6,511,824; 6,515,109; 6,489,127.

Modification of Nucleic Acids

The invention provides methods of generating variants of the nucleic acids of the invention, e.g., those encoding an ammonia lyase, e.g., phenylalanine ammonia lyase, tyrosine ammonia lyase and/or histidine ammonia lyase enzyme. These methods can be repeated or used in various combinations to generate ammonia lyase, e.g., phenylalanine ammonia lyase, tyrosine ammonia lyase and/or histidine ammonia lyase enzymes having an altered or different activity or an altered or different stability from that of an ammonia lyase, e.g., phenylalanine ammonia lyase, tyrosine ammonia lyase and/or histidine ammonia lyase enzyme encoded by the template nucleic acid. These methods also can be repeated or used in various combinations, e.g., to generate variations in gene/message expression, message translation or message stability. In another aspect, the genetic composition of a cell is altered by, e.g., modification of a homologous gene ex vivo, followed by its reinsertion into the cell.

A nucleic acid of the invention can be altered by any means. For example, random or stochastic methods, or, non-stochastic, or "directed evolution," methods, see, e.g., U.S. Pat. No. 6,361,974. Methods for random mutation of genes are well known in the art, see, e.g., U.S. Pat. No. 5,830,696. For example, mutagens can be used to randomly mutate a gene. Mutagens include, e.g., ultraviolet light or gamma irradiation, or a chemical mutagen, e.g., mitomycin, nitrous acid, photo-activated psoralens, alone or in combination, to induce DNA breaks amenable to repair by recombination. Other chemical mutagens include, for example, sodium bisulfite, nitrous acid, hydroxylamine, hydrazine or formic acid. Other mutagens are analogues of nucleotide precursors, e.g., nitrosoguanidine, 5-bromouracil, 2-aminopurine, or acridine. These agents can be added to a PCR reaction in place of the nucleotide precursor thereby mutating the sequence. Intercalating agents such as proflavine, acriflavine, quinacrine and the like can also be used.

Any technique in molecular biology can be used, e.g., random PCR mutagenesis, see, e.g., Rice (1992) Proc. Natl. Acad. Sci. USA 89:5467-5471; or, combinatorial multiple cassette mutagenesis, see, e.g., Crameri (1995) Biotechniques 18:194-196. Alternatively, nucleic acids, e.g., genes, can be reassembled after random, or "stochastic," fragmentation, see, e.g., U.S. Pat. Nos. 6,291,242; 6,287,862; 6,287,861; 5,955,358; 5,830,721; 5,824,514; 5,811,238; 5,605,793. In alternative aspects, modifications, additions or deletions are introduced by error-prone PCR, shuffling, oligonucleotide-directed mutagenesis, assembly PCR, sexual PCR mutagenesis, in vivo mutagenesis, cassette mutagenesis, recursive ensemble mutagenesis, exponential ensemble mutagenesis, site-specific mutagenesis, gene reassembly, Gene Site Saturation Mutagenesis (GSSM), synthetic ligation reassembly (SLR), recombination, recursive sequence recombination, phosphothioate-modified DNA mutagenesis, uracil-containing template mutagenesis, gapped duplex mutagenesis, point mismatch repair mutagenesis, repair-deficient host strain mutagenesis, chemical mutagenesis, radiogenic mutagenesis, deletion mutagenesis, restriction-selection mutagenesis, restriction-purification mutagenesis, artificial gene synthesis, ensemble mutagenesis, chimeric nucleic acid multimer creation, and/or a combination of these and other methods.

In one aspect, a metagenomic discovery and a non-stochastic method of directed evolution (called "DIRECTEVOLUTION®, as described, e.g., in U.S. Pat. No. 6,939,689, which includes Gene Site Saturation Mutagenesis (GSSM) (as discussed above, see also U.S. Pat. Nos. 6,171,820 and 6,579,258) and Tunable GeneReassembly (TGR) (see, e.g., U.S. Pat. No. 6,537,776) technology is used to practice the invention, e.g., for the discovery and/or optimization of lyases of the invention.

The following publications describe a variety of recursive recombination procedures and/or methods which can be incorporated into the methods of the invention: Stemmer (1999) "Molecular breeding of viruses for targeting and other clinical properties" Tumor Targeting 4:1-4; Ness (1999) Nature Biotechnology 17:893-896; Chang (1999) "Evolution of a cytokine using DNA family shuffling" Nature Biotechnology 17:793-797; Minshull (1999) "Protein evolution by molecular breeding" Current Opinion in Chemical Biology 3:284-290; Christians (1999) "Directed evolution of thymidine kinase for AZT phosphorylation using DNA family shuffling" Nature Biotechnology 17:259-264; Crameri (1998) "DNA shuffling of a family of genes from diverse species accelerates directed evolution" Nature 391:288-291; Crameri (1997) "Molecular evolution of an arsenate detoxification pathway by DNA shuffling," Nature Biotechnology 15:436-438; Zhang (1997) "Directed evolution of an effective fucosidase from a galactosidase by DNA shuffling and screening" Proc. Natl. Acad. Sci. USA 94:4504-4509; Patten et al. (1997) "Applications of DNA Shuffling to Pharmaceuticals and Vaccines" Current Opinion in Biotechnology 8:724-733; Crameri et al. (1996) "Construction and evolution of antibody-phage libraries by DNA shuffling" Nature Medicine 2:100-103; Gates et al. (1996) "Affinity selective isolation of ligands from peptide libraries through display on a lac repressor 'headpiece dimer'$^{MI}$ Journal of Molecular Biology 255: 373-386; Stemmer (1996) "Sexual PCR and Assembly PCR" In: The Encyclopedia of Molecular Biology. VCH Publishers, New York. pp. 447-457; Crameri and Stemmer (1995) "Combinatorial multiple cassette mutagenesis creates all the permutations of mutant and wildtype cassettes" BioTechniques 18:194-195; Stemmer et al. (1995) "Single-step assembly of a gene and entire plasmid form large numbers of oligodeoxyribonucleotides" Gene, 164:49-53; Stemmer (1995) "The Evolution of Molecular Computation" Science 270: 1510; Stemmer (1995) "Searching Sequence Space" Bio/Technology 13:549-553; Stemmer (1994) "Rapid evolution of a protein in vitro by DNA shuffling" Nature 370:389-391; and Stemmer (1994) "DNA shuffling by random fragmentation and reassembly: In vitro recombination for molecular evolution."Proc. Natl. Acad. Sci. USA 91:10747-10751.

Mutational methods of generating diversity include, for example, site-directed mutagenesis (Ling et al. (1997) "Approaches to DNA mutagenesis: an overview" Anal Biochem. 254(2): 157-178; Dale et al. (1996) "Oligonucleotide-directed random mutagenesis using the phosphorothioate method" Methods MoI. Biol. 57:369-374; Smith (1985) "hi vitro mutagenesis" Ann. Rev. Genet. 19:423-462; Botstein & Shortie (1985) "Strategies and applications of in vitro mutagenesis" Science 229:1193-1201; Carter (1986) "Site-directed mutagenesis" Biochem. J. 237:1-7; and Kunkel (1987) "The efficiency of oligonucleotide directed mutagenesis" in Nucleic Acids & Molecular Biology (Eckstein, F. and Lilley, D. M. J. eds., Springer Verlag, Berlin)); mutagenesis using uracil containing templates (Kunkel (1985) "Rapid and efficient site-specific mutagenesis without phenotypic selection" Proc. Natl. Acad. Sci. USA 82:488-492; Kunkel et al. (1987) "Rapid and efficient site-specific mutagenesis without phenotypic selection" Methods in Enzymol. 154, 367-382; and Bass et al. (1988) "Mutant Trp repressors with new DNA-binding specificities" Science 242:240-245); oligonucleotide-directed mutagenesis (Methods in Enzymol. 100: 468-500 (1983); Methods in Enzymol. 154: 329-350 (1987); Zoller (1982) "Oligonucleotide-directed mutagenesis using M13-derived vectors: an efficient and general procedure for the production of point mutations in any DNA fragment" Nucleic Acids Res. 10:6487-6500; Zoller & Smith (1983) "Oligonucleotide-directed mutagenesis of DNA fragments cloned into M13 vectors" Methods in Enzymol. 100:468-500; and Zoller (1987) Oligonucleotide-directed mutagenesis: a simple method using two oligonucleotide primers and a single-stranded DNA template" Methods in Enzymol. 154: 329-350); phosphorothioate-modified DNA mutagenesis (Taylor (1985) The use of phosphorothioate-modified DNA in restriction enzyme reactions to prepare nicked DNA" Nucl. Acids Res. 13: 8749-8764; Taylor (1985) The rapid generation of oligonucleotide-directed mutations at high frequency using phosphorothioate-modified DNA" Nucl. Acids Res. 13: 8765-8787 (1985); Nakamaye (1986) "Inhibition of restriction endonuclease Nci I cleavage by phosphorothioate groups and its application to oligonucleotide-directed mutagenesis" Nucl. Acids Res. 14: 9679-9698; Sayers (1988) "Y-T Exonucleases in phosphorothioate-based oligonucleotide-directed mutagenesis" Nucl. Acids Res. 16:791-802; and Sayers et al. (1988) "Strand specific cleavage of phosphorothioate-containing DNA by reaction with restriction endonucleases in the presence of ethidium bromide" Nucl. Acids Res. 16: 803-814); mutagenesis using gapped duplex DNA (Kramer et al. (1984) "The gapped duplex DNA approach to oligonucleotide-directed mutation construction" Nucl. Acids Res. 12: 9441-9456; Kramer & Fritz (1987) Methods in Enzymol. "Oligonucleotide-directed construction of mutations via gapped duplex DNA" 154:350-367; Kramer (1988) "Improved enzymatic in vitro reactions in the gapped duplex DNA approach to oligonucleotide-directed construction of mutations" Nucl. Acids Res. 16: 7207; and Fritz (1988) "Oligonucleotide-directed construction of mutations: a gapped duplex DNA procedure without enzymatic reactions in vitro" Nucl. Acids Res. 16: 6987-6999).

Additional protocols that can be used to practice the invention include point mismatch repair (Kramer (1984) "Point Mismatch Repair" Cell 38:879-887), mutagenesis using repair-deficient host strains (Carter et al. (1985) "Improved oligonucleotide site-directed mutagenesis using M 13 vectors" Nucl. Acids Res. 13: 4431-4443; and Carter (1987) "Improved oligonucleotide-directed mutagenesis using M13 vectors" Methods in Enzymol. 154: 382-403), deletion mutagenesis (Eghtedarzadeh (1986) "Use of oligonucleotides to generate large deletions" Nucl. Acids Res. 14: 5115), restriction-selection and restriction-selection and restriction-purification (Wells et al. (1986) "Importance of hydrogen-bond formation in stabilizing the transition state of subtilisin" Phil. Trans. R. Soc. Lond. A 317: 415-423), mutagenesis by total gene synthesis (Nambiar et al. (1984) "Total synthesis and cloning of a gene coding for the ribonuclease S protein" Science 223: 1299-1301; Sakamar and Khorana (1988) "Total synthesis and expression of a gene for the a-subunit of bovine rod outer segment guanine nucleotide-binding protein (transducin)" Nucl. Acids Res. 14: 6361-6372; Wells et al. (1985) "Cassette mutagenesis: an efficient method for generation of multiple mutations at defined sites" Gene 34:315-323; and Grundstrom et al. (1985) "Oligonucleotide-directed mutagenesis by microscale 'shotgun' gene synthesis" Nucl. Acids Res. 13: 3305-33 16), double-strand break repair (Mandecki (1986); Arnold (1993) "Protein engineering for unusual environments" Current Opinion in Biotechnology 4:450-455. "Oligonucleotide-directed double-strand break repair in plasmids of *Escherichia coli*: a method for site-specific mutagenesis" Proc. Natl. Acad. Sci. USA, 83:7177-7181). Additional details on many of the above methods can be found in Methods in Enzymology Volume 154, which also describes useful controls for trouble-shooting problems with various mutagenesis methods.

Protocols that can be used to practice the invention are described, e.g., in U.S. Pat. No. 5,605,793 to Stemmer (Feb. 25, 1997), "Methods for In Vitro Recombination;" U.S. Pat. No. 5,811,238 to Stemmer et al. (Sep. 22, 1998) "Methods for Generating Polynucleotides having Desired Characteristics by Iterative Selection and Recombination;" U.S. Pat. No. 5,830,721 to Stemmer et al. (Nov. 3, 1998), "DNA Mutagenesis by Random Fragmentation and Reassembly;" U.S. Pat. No. 5,834,252 to Stemmer, et al. (Nov. 10, 1998) "End-Complementary Polymerase Reaction;" U.S. Pat. No. 5,837,458 to Minshull, et al. (Nov. 17, 1998), "Methods and Compositions for Cellular and Metabolic Engineering;" WO 95/22625, Stemmer and Crameri, "Mutagenesis by Random Fragmentation and Reassembly;" WO 96/33207 by Stemmer and Lipschutz "End Complementary Polymerase Chain Reaction;" WO 97/20078 by Stemmer and Crameri "Methods for Generating Polynucleotides having Desired Characteristics by Iterative Selection and Recombination;" WO 97/35966 by Minshull and Stemmer, "Methods and Compositions for Cellular and Metabolic Engineering;" WO 99/41402 by Punnonen et al. "Targeting of Genetic Vaccine Vectors;" WO 99/41383 by Punnonen et al. "Antigen Library Immunization;" WO 99/41369 by Punnonen et al. "Genetic Vaccine Vector Engineering;" WO 99/41 368 by Punnonen et al. "Optimization of Immunomodulatory Properties of Genetic Vaccines;" EP 752008 by Stemmer and Crameri, "DNA Mutagenesis by Random Fragmentation and Reassembly;" EP 0932670 by Stemmer "Evolving Cellular DNA Uptake by Recursive Sequence Recombination;" WO 99/23107 by Stemmer et al., "Modification of Virus Tropism and Host Range by Viral Genome Shuffling;" WO 99/21979 by Apt et al., "Human Papillomavirus Vectors;"WO 98/31837 by del Cardayre et al. "Evolution of Whole Cells and Organisms by Recursive Sequence Recombination;" WO 98/27230 by Patten and Stemmer, "Methods and Compositions for Polypeptide Engineering;" WO 98/27230 by Stemmer et al., "Methods for Optimization of Gene Therapy by Recursive Sequence Shuffling and Selection," WO 00/00632, "Methods for Generating Highly Diverse Libraries," WO 00/09679, "Methods for Obtaining in Vitro Recombined Polynucleotide Sequence Banks and Resulting Sequences," WO 98/42832 by Arnold et al., "Recombination of Polynucleotide Sequences Using Random or Defined Primers," WO 99/29902 by Arnold et al., "Method for Creating Polynucleotide and Polypeptide Sequences," WO 98/41653 by Vind, "An in Vitro Method for Construction of a DNA Library," WO 98/41 622 by Borchert et al., "Method for Constructing a Library Using DNA Shuffling," and WO 98/42727 by Pati and Zarling, "Sequence Alterations using Homologous Recombination."

Protocols that can be used to practice the invention (providing details regarding various diversity generating methods) are described, e.g., in U.S. patent application Ser. No. 09/407,800, "SHUFFLING OF CODON ALTERED GENES" by Patten et al. filed Sep. 28, 1999; "EVOLUTION OF WHOLE CELLS AND ORGANISMS BY RECURSIVE SEQUENCE RECOMBINATION" by del Cardayre et al., U.S. Pat. No. 6,379,964; "OLIGONUCLEOTIDE MEDIATED NUCLEIC ACID RECOMBINATION" by Crameri et al., U.S. Pat. Nos. 6,319,714; 6,368,861; 6,376,246; 6,423, 542; 6,426,224 and PCT/USOO/01203; "USE OF CODON-VARIED OLIGONUCLEOTIDE SYNTHESIS FOR SYNTHETIC SHUFFLING" by Welch et al., U.S. Pat. No. 6,436, 675; "METHODS FOR MAKING CHARACTER STRINGS, POLYNUCLEOTIDES & POLYPEPTIDES HAVING DESIRED CHARACTERISTICS" by Selifonov et al., filed Jan. 18, 2000, (PCT/US00/01202) and, e.g. "METHODS FOR MAKING CHARACTER STRINGS, POLYNUCLEOTIDES & POLYPEPTIDES HAVING DESIRED CHARACTERISTICS" by Selifonov et al., filed Jul. 18, 2000 (U.S. Ser. No. 09/618,579); "METHODS OF POPULATING DATA STRUCTURES FORUSE IN EVOLUTIONARY SIMULATIONS" by Selifonov and Stemmer, filed Jan. 18, 2000 (PCT/US00/01138); and "SINGLE-STRANDED NUCLEIC ACID TEMPLATE-MEDIATED RECOMBINATION AND NUCLEIC ACID FRAGMENT ISOLATION" by Affholter, filed Sep. 6, 2000 (U.S. Ser. No. 09/656,549); and U.S. Pat. Nos. 6,177,263; 6,153,410.

Non-stochastic, or "directed evolution," methods include, e.g., saturation mutagenesis, such as Gene Site Saturation Mutagenesis (GSSM), synthetic ligation reassembly (SLR), or a combination thereof are used to modify the nucleic acids of the invention to generate ammonia lyase, e.g., phenylalanine ammonia lyase, tyrosine ammonia lyase and/or histidine ammonia lyase enzymes with new or altered properties (e.g., activity under highly acidic or alkaline conditions, high or low temperatures, and the like). Polypeptides encoded by the modified nucleic acids can be screened for an activity before testing for glucan hydrolysis or other activity. Any testing modality or protocol can be used, e.g., using a capillary array platform. See, e.g., U.S. Pat. Nos. 6,361,974; 6,280,926; 5,939,250.

Gene Site Saturation mutagenesis, or, GSSM

The invention also provides methods for making enzyme using Gene Site Saturation mutagenesis, or, GSSM, as described herein, and also in U.S. Pat. Nos. 6,171,820 and 6,579,258.

In one aspect, codon primers containing a degenerate N,N, G/T sequence are used to introduce point mutations into a polynucleotide, e.g., an ammonia lyase, e.g., phenylalanine ammonia lyase, tyrosine ammonia lyase and/or histidine ammonia lyase enzyme or an antibody of the invention, so as to generate a set of progeny polypeptides in which a full range of single amino acid substitutions is represented at each amino acid position, e.g., an amino acid residue in an enzyme active site or ligand binding site targeted to be modified. These oligonucleotides can comprise a contiguous first homologous sequence, a degenerate N,N,G/T sequence, and, optionally, a second homologous sequence. The downstream progeny translational products from the use of such oligonucleotides include all possible amino acid changes at each amino acid site along the polypeptide, because the degeneracy of the $N_5N,G/T$ sequence includes codons for all 20 amino acids. In one aspect, one such degenerate oligonucleotide (comprised of, e.g., one degenerate N,N,G/T cassette) is used for subjecting each original codon in a parental polynucleotide template to a full range of codon substitutions. In another aspect, at least two degenerate cassettes are used— either in the same oligonucleotide or not, for subjecting at least two original codons in a parental polynucleotide template to a full range of codon substitutions. For example, more than one N,N,G/T sequence can be contained in one oligonucleotide to introduce amino acid mutations at more than one site. This plurality of N,N,G/T sequences can be directly contiguous, or separated by one or more additional nucleotide sequence(s). In another aspect, oligonucleotides serviceable for introducing additions and deletions can be used either alone or in combination with the codons containing an N,N, G/T sequence, to introduce any combination or permutation of amino acid additions, deletions, and/or substitutions.

In one aspect, simultaneous mutagenesis of two or more contiguous amino acid positions is done using an oligonucleotide that contains contiguous N,N,G/T triplets, i.e. a degenerate (N,N,G/T)n sequence. In another aspect, degenerate cassettes having less degeneracy than the $N_3N,G/T$ sequence are used. For example, it may be desirable in some instances to use (e.g. in an oligonucleotide) a degenerate triplet sequence comprised of only one N, where said N can be in the first second or third position of the triplet. Any other bases including any combinations and permutations thereof can be used in the remaining two positions of the triplet. Alternatively, it may be desirable in some instances to use (e.g. in an oligo) a degenerate $N_5N_5N$ triplet sequence.

In one aspect, use of degenerate triplets (e.g., N,N,G/T triplets) allows for systematic and easy generation of a full range of possible natural amino acids (for a total of 20 amino acids) into each and every amino acid position in a polypeptide (in alternative aspects, the methods also include generation of less than all possible substitutions per amino acid residue, or codon, position). For example, for a 100 amino acid polypeptide, 2000 distinct species (i.e. 20 possible amino acids per position X 100 amino acid positions) can be generated. Through the use of an oligonucleotide or set of oligonucleotides containing a degenerate $N_5N$,GAT triplet, 32 individual sequences can code for all 20 possible natural amino acids. Thus, in a reaction vessel in which a parental polynucleotide sequence is subjected to saturation mutagenesis using at least one such oligonucleotide, there are generated 32 distinct progeny polynucleotides encoding 20 distinct polypeptides. In contrast, the use of a non-degenerate oligonucleotide in site-directed mutagenesis leads to only one progeny polypeptide product per reaction vessel. Nondegenerate oligonucleotides can optionally be used in combination with degenerate primers disclosed; for example, nondegenerate oligonucleotides can be used to generate specific point mutations in a worldng polynucleotide. This provides one means to generate specific silent point mutations, point mutations leading to corresponding amino acid changes, and point mutations that cause the generation of stop codons and the corresponding expression of polypeptide fragments.

In one aspect, each saturation mutagenesis reaction vessel contains polynucleotides encoding at least 20 progeny polypeptide (e.g., ammonia lyase, e.g., phenylalanine ammonia lyase, tyrosine ammonia lyase and/or histidine ammonia lyase enzymes) molecules such that all 20 natural amino acids are represented at the one specific amino acid position corresponding to the codon position mutagenized in the parental polynucleotide (other aspects use less than all 20 natural combinations). The 32-fold degenerate progeny polypeptides generated from each saturation mutagenesis reaction vessel can be subjected to clonal amplification (e.g. cloned into a suitable host, e.g., E. coli host, using, e.g., an expression vector) and subjected to expression screening. When an individual progeny polypeptide is identified by screening to display a favorable change in property (when compared to the parental polypeptide, such as increased glucan hydrolysis activity under alkaline or acidic conditions), it can be sequenced to identify the correspondingly favorable amino acid substitution contained therein.

In one aspect, upon mutagenizing each and every amino acid position in a parental polypeptide using saturation mutagenesis as disclosed herein, favorable amino acid changes may be identified at more than one amino acid position. One or more new progeny molecules can be generated that contain a combination of all or part of these favorable amino acid substitutions. For example, if 2 specific favorable amino acid changes are identified in each of 3 amino acid positions in a polypeptide, the permutations include 3 possibilities at each position (no change from the original amino acid, and each of two favorable changes) and 3 positions. Thus, there are 3×3×3 or 27 total possibilities, including 7 that were previously examined—6 single point mutations (i.e. 2 at each of three positions) and no change at any position.

In yet another aspect, site-saturation mutagenesis can be used together with shuffling, chimerization, recombination and other mutagenizing processes, along with screening. This invention provides for the use of any mutagenizing process (es), including saturation mutagenesis, in an iterative manner. In one exemplification, the iterative use of any mutagenizing process(es) is used in combination with screening.

The invention also provides for the use of proprietary codon primers (containing a degenerate N,N,N sequence) to introduce point mutations into a polynucleotide, so as to generate a set of progeny polypeptides in which a full range of single amino acid substitutions is represented at each amino acid position (Gene Site Saturation Mutagenesis (GSSM)). The oligos used are comprised contiguously of a first homologous sequence, a degenerate N,N,N sequence and in one aspect but not necessarily a second homologous sequence. The downstream progeny translational products from the use of such oligos include all possible amino acid changes at each amino acid site along the polypeptide, because the degeneracy of the N,N,N sequence includes codons for all 20 amino acids.

In one aspect, one such degenerate oligo (comprised of one degenerate N,N,N cassette) is used for subjecting each original codon in a parental polynucleotide template to a full range of codon substitutions. In another aspect, at least two degenerate N,N,N cassettes are used—either in the same oligo or not, for subjecting at least two original codons in a parental polynucleotide template to a full range of codon substitutions. Thus, more than one N,N,N sequence can be contained in one oligo to introduce amino acid mutations at more than one site. This plurality of $N_5N,N$ sequences can be directly contiguous, or separated by one or more additional nucleotide sequence(s). In another aspect, oligos serviceable for introducing additions and deletions can be used either alone or in combination with the codons containing an $N_5N_5N$ sequence, to introduce any combination or permutation of amino acid additions, deletions and/or substitutions.

In a particular exemplification, it is possible to simultaneously mutagenize two or more contiguous amino acid positions using an oligo that contains contiguous N,N,N triplets, i.e. a degenerate $(N,N_5N)_n$ sequence.

In another aspect, the present invention provides for the use of degenerate cassettes having less degeneracy than the $N_5N_3N$ sequence. For example, it may be desirable in some instances to use (e.g. in an oligo) a degenerate triplet sequence comprised of only one N, where the N can be in the first second or third position of the triplet. Any other bases including any combinations and permutations thereof can be used in the remaining two positions of the triplet. Alternatively, it may be desirable in some instances to use (e.g., in an oligo) a degenerate $N_5N_5N$ triplet sequence, $N_5N$,GAT, or an $N_5N$, G/C triplet sequence.

It is appreciated, however, that the use of a degenerate triplet (such as N,N,G/T or an N,N, G/C triplet sequence) as disclosed in the instant invention is advantageous for several reasons. In one aspect, this invention provides a means to systematically and fairly easily generate the substitution of the full range of possible amino acids (for a total of 20 amino acids) into each and every amino acid position in a polypeptide. Thus, for a 100 amino acid polypeptide, the invention provides a way to systematically and fairly easily generate 2000 distinct species (i.e., 20 possible amino acids per position times 100 amino acid positions). It is appreciated that there is provided, through the use of an oligo containing a degenerate $N,N_5$GAT or an $N_5N_5$G/C triplet sequence, 32 individual sequences that code for 20 possible amino acids. Thus, in a reaction vessel in which a parental polynucleotide sequence is subjected to saturation mutagenesis using one such oligo, there are generated 32 distinct progeny polynucleotides encoding 20 distinct polypeptides. In contrast, the use of a non-degenerate oligo in site-directed mutagenesis leads to only one progeny polypeptide product per reaction vessel.

This invention also provides for the use of nondegenerate oligos, which can optionally be used in combination with degenerate primers disclosed. It is appreciated that in some situations, it is advantageous to use nondegenerate oligos to generate specific point mutations in a working polynucleotide. This provides a means to generate specific silent point mutations, point mutations leading to corresponding amino acid changes and point mutations that cause the generation of stop codons and the corresponding expression of polypeptide fragments.

Thus, in one aspect of this invention, each saturation mutagenesis reaction vessel contains polynucleotides encoding at least 20 progeny polypeptide molecules such that all 20 amino acids are represented at the one specific amino acid position corresponding to the codon position mutagenized in the parental polynucleotide. The 32-fold degenerate progeny polypeptides generated from each saturation mutagenesis reaction vessel can be subjected to clonal amplification (e.g., cloned into a suitable E. coli host using an expression vector) and subjected to expression screening. When an individual progeny polypeptide is identified by screening to display a favorable change in property (when compared to the parental polypeptide), it can be sequenced to identify the correspondingly favorable amino acid substitution contained therein.

It is appreciated that upon mutagenizing each and every amino acid position in a parental polypeptide using saturation mutagenesis as disclosed herein, favorable amino acid changes may be identified at more than one amino acid position. One or more new progeny molecules can be generated that contain a combination of all or part of these favorable amino acid substitutions. For example, if 2 specific favorable amino acid changes are identified in each of 3 amino acid positions in a polypeptide, the permutations include 3 possibilities at each position (no change from the original amino acid and each of two favorable changes) and 3 positions. Thus, there are 3×3×3 or 27 total possibilities, including 7 that were previously examined—6 single point mutations (i.e., 2 at each of three positions) and no change at any position.

Thus, in a non-limiting exemplification, this invention provides for the use of saturation mutagenesis in combination with additional mutagenization processes, such as process where two or more related polynucleotides are introduced into a suitable host cell such that a hybrid polynucleotide is generated by recombination and reductive reassortment.

In addition to performing mutagenesis along the entire sequence of a gene, the instant invention provides that mutagenesis can be use to replace each of any number of bases in a polynucleotide sequence, wherein the number of bases to be mutagenized is in one aspect every integer from 15 to 100,000. Thus, instead of mutagenizing every position along a molecule, one can subject every or a discrete number of bases (in one aspect a subset totaling from 15 to 100,000) to mutagenesis, hi one aspect, a separate nucleotide is used for mutagenizing each position or group of positions along a polynucleotide sequence. A group of 3 positions to be mutagenized may be a codon. The mutations can be introduced using a mutagenic primer, containing a heterologous cassette, also referred to as a mutagenic cassette. Exemplary cassettes can have from 1 to 500 bases. Each nucleotide position in such heterologous cassettes be N, A, C, G, T, AJC, AJG, AJT, C/G, C/T, GIT, C/G/T, A/G/T, A/C/T, A/C/G, or E, where E is any base that is not A, C, G, or T (E can be referred to as a designer oligo).

In a general sense, saturation mutagenesis is comprised of mutagenizing a complete set of mutagenic cassettes (wherein each cassette is in one aspect about 1-500 bases in length) in defined polynucleotide sequence to be mutagenized (wherein the sequence to be mutagenized is in one aspect from about 15 to 100,000 bases in length). Thus, a group of mutations (ranging from 1 to 100 mutations) is introduced into each cassette to be mutagenized. A grouping of mutations to be introduced into one cassette can be different or the same from a second grouping of mutations to be introduced into a second cassette during the application of one round of saturation mutagenesis. Such groupings are exemplified by deletions, additions, groupings of particular codons and groupings of particular nucleotide cassettes.

Defined sequences to be mutagenized include a whole gene, pathway, cDNA, an entire open reading frame (ORF) and entire promoter, enhancer, repressor/transactivator, origin of replication, intron, operator, or any polynucleotide functional group. Generally, a "defined sequences" for this purpose may be any polynucleotide that a 15 base-polynucleotide sequence and polynucleotide sequences of lengths between 15 bases and 15,000 bases (this invention specifically names every integer in between). Considerations in choosing groupings of codons include types of amino acids encoded by a degenerate mutagenic cassette.

In one exemplification a grouping of mutations that can be introduced into a mutagenic cassette, this invention specifically provides for degenerate codon substitutions (using degenerate oligos) that code for 2, 3, 4, 5, 6, 7, 8, 9, 10, 11, 12, 13, 14, 15, 16, 17, 18, 19 and 20 amino acids at each position and a library of polypeptides encoded thereby.

Synthetic Ligation Reassembly (SLR)

The invention provides a non-stochastic gene modification system termed "synthetic ligation reassembly," or simply "SLR," a "directed evolution process," to generate polypeptides, e.g., ammonia lyase, e.g., phenylalanine ammonia lyase, tyrosine ammonia lyase and/or histidine ammonia lyase enzymes or antibodies of the invention, with new or altered properties. SLR is a method of ligating oligonucleotide fragments together non-stochastically. This method differs from stochastic oligonucleotide shuffling in that the nucleic acid building blocks are not shuffled, concatenated or chimerized randomly, but rather are assembled non-stochastically. See, e.g., U.S. Pat. Nos. 6,773,900; 6,740,506; 6,713,282; 6,635,449; 6,605,449; 6,537,776.

In one aspect, SLR comprises the following steps: (a) providing a template polynucleotide, wherein the template polynucleotide comprises sequence encoding a homologous gene; (b) providing a plurality of building block polynucleotides, wherein the building block polynucleotides are designed to cross-over reassemble with the template polynucleotide at a predetermined sequence, and a building block polynucleotide comprises a sequence that is a variant of the homologous gene and a sequence homologous to the template polynucleotide flanking the variant sequence; (c) combining a building block polynucleotide with a template polynucleotide such that the building block polynucleotide cross-over reassembles with the template polynucleotide to generate polynucleotides comprising homologous gene sequence variations.

SLR does not depend on the presence of high levels of homology between polynucleotides to be rearranged. Thus, this method can be used to non-stochastically generate libraries (or sets) of progeny molecules comprised of over $10^{100}$ different chimeras. SLR can be used to generate libraries comprised of over i o$^{1000}$ different progeny chimeras. Thus, aspects of the present invention include non-stochastic methods of producing a set of finalized chimeric nucleic acid molecule shaving an overall assembly order that is chosen by design. This method includes the steps of generating by design a plurality of specific nucleic acid building blocks having serviceable mutually compatible ligatable ends, and assembling these nucleic acid building blocks, such that a designed overall assembly order is achieved.

The mutually compatible ligatable ends of the nucleic acid building blocks to be assembled are considered to be "serviceable" for this type of ordered assembly if they enable the building blocks to be coupled in predetermined orders. Thus, the overall assembly order in which the nucleic acid building blocks can be coupled is specified by the design of the ligatable ends. If more than one assembly step is to be used, then the overall assembly order in which the nucleic acid building blocks can be coupled is also specified by the sequential order of the assembly step(s). In one aspect, the annealed building pieces are treated with an enzyme, such as a ligase (e.g. T4 DNA ligase), to achieve covalent bonding of the building pieces.

In one aspect, the design of the oligonucleotide building blocks is obtained by analyzing a set of progenitor nucleic acid sequence templates that serve as a basis for producing a progeny set of finalized chimeric polynucleotides. These parental oligonucleotide templates thus serve as a source of sequence information that aids in the design of the nucleic acid building blocks that are to be mutagenized, e.g., chimerized or shuffled. In one aspect of this method, the sequences of a plurality of parental nucleic acid templates are aligned in order to select one or more demarcation points. The demarcation points can be located at an area of homology, and are comprised of one or more nucleotides. These demarcation points are in one aspect shared by at least two of the progenitor templates. The demarcation points can thereby be used to delineate the boundaries of oligonucleotide building blocks to be generated in order to rearrange the parental polynucleotides. The demarcation points identified and selected in the progenitor molecules serve as potential chimerization points in the assembly of the final chimeric progeny molecules. A demarcation point can be an area of homology (comprised of at least one homologous nucleotide base) shared by at least two parental polynucleotide sequences. Alternatively, a demarcation point can be an area of homology that is shared by at least half of the parental polynucleotide sequences, or, it can be an area of homology that is shared by at least two thirds of the parental polynucleotide sequences. Even more in one aspect a serviceable demarcation points is an area of homology that is shared by at least three fourths of the parental polynucleotide sequences, or, it can be shared by at almost all of the parental polynucleotide sequences, hi one aspect, a demarcation point is an area of homology that is shared by all of the parental polynucleotide sequences.

hi one aspect, a ligation reassembly process is performed exhaustively in order to generate an exhaustive library of progeny chimeric polynucleotides. In other words, all possible ordered combinations of the nucleic acid building blocks are represented in the set of finalized chimeric nucleic acid molecules. At the same time, in another aspect, the assembly order (i.e. the order of assembly of each building block in the 5' to 3 sequence of each finalized chimeric nucleic acid) in each combination is by design (or non-stochastic) as described above. Because of the non-stochastic nature of this invention, the possibility of unwanted side products is greatly reduced.

In another aspect, the ligation reassembly method is performed systematically. For example, the method is performed in order to generate a systematically compartmentalized library of progeny molecules, with compartments that can be screened systematically, e.g. one by one. In other words this invention provides that, through the selective and judicious use of specific nucleic acid building blocks, coupled with the selective and judicious use of sequentially stepped assembly reactions, a design can be achieved where specific sets of progeny products are made in each of several reaction vessels. This allows a systematic examination and screening procedure to be performed. Thus, these methods allow a potentially very large number of progeny molecules to be examined systematically in smaller groups. Because of its ability to perform chimerizations in a manner that is highly flexible yet exhaustive and systematic as well, particularly when there is a low level of homology among the progenitor molecules, these methods provide for the generation of a library (or set) comprised of a large number of progeny molecules. Because of the non-stochastic nature of the instant ligation reassembly invention, the progeny molecules generated in one aspect comprise a library of finalized chimeric nucleic acid molecules having an overall assembly order that is chosen by design. The saturation mutagenesis and optimized directed evolution methods also can be used to generate different progeny molecular species. It is appreciated that the invention provides freedom of choice and control regarding the selection of demarcation points, the size and number of the nucleic acid building blocks, and the size and design of the couplings. It is appreciated, furthermore, that the requirement for intermolecular homology is highly relaxed for the operability of this invention. In fact, demarcation points can even be chosen in areas of little or no intermolecular homology. For example, because of codon wobble, i.e. the degeneracy of codons, nucleotide substitutions can be introduced into nucleic acid building blocks without altering the amino acid originally encoded in the corresponding progenitor template. Alternatively, a codon can be altered such that the coding for an originally amino acid is altered. This invention provides that such substitutions can be introduced into the nucleic acid building block in order to increase the incidence of intermolecular homologous demarcation points and thus to allow an increased number of couplings to be achieved among the building blocks, which in turn allows a greater number of progeny chimeric molecules to be generated.

In one aspect, the present invention provides a non-stochastic method termed synthetic gene reassembly, that is somewhat related to stochastic shuffling, save that the nucleic acid building blocks are not shuffled or concatenated or chimerized randomly, but rather are assembled non-stochastically.

The synthetic gene reassembly method does not depend on the presence of a high level of homology between polynucleotides to be shuffled. The invention can be used to non-stochastically generate libraries (or sets) of progeny molecules comprised of over $10^{100}$ different chimeras. Conceivably, synthetic gene reassembly can even be used to generate libraries comprised of over $10^{1000}$ different progeny chimeras.

Thus, in one aspect, the invention provides a non-stochastic method of producing a set of finalized chimeric nucleic acid molecules having an overall assembly order that is chosen by design, which method is comprised of the steps of generating by design a plurality of specific nucleic acid building blocks having serviceable mutually compatible ligatable ends and assembling these nucleic acid building blocks, such that a designed overall assembly order is achieved.

The mutually compatible ligatable ends of the nucleic acid building blocks to be assembled are considered to be "serviceable" for this type of ordered assembly if they enable the building blocks to be coupled in predetermined orders. Thus, in one aspect, the overall assembly order in which the nucleic acid building blocks can be coupled is specified by the design of the ligatable ends and, if more than one assembly step is to be used, then the overall assembly order in which the nucleic acid building blocks can be coupled is also specified by the sequential order of the assembly step(s). In a one aspect of the invention, the annealed building pieces are treated with an enzyme, such as a ligase (e.g., T4 DNA ligase) to achieve covalent bonding of the building pieces.

In a another aspect, the design of nucleic acid building blocks is obtained upon analysis of the sequences of a set of progenitor nucleic acid templates that serve as a basis for producing a progeny set of finalized chimeric nucleic acid molecules. These progenitor nucleic acid templates thus serve as a source of sequence information that aids in the design of the nucleic acid building blocks that are to be mutagenized, i.e. chimerized or shuffled.

In one exemplification, the invention provides for the chimerization of a family of related genes and their encoded family of related products. In a particular exemplification, the encoded products are enzymes. The ammonia lyase, e.g., phenylalanine ammonia lyase, tyrosine ammonia lyase and/or histidine ammonia lyase enzymes of the present invention can be mutagenized in accordance with the methods described herein.

Thus according to one aspect of the invention, the sequences of a plurality of progenitor nucleic acid templates (e.g., polynucleotides of the invention) are aligned in order to select one or more demarcation points, which demarcation points can be located at an area of homology. The demarcation points can be used to delineate the boundaries of nucleic acid building blocks to be generated. Thus, the demarcation points identified and selected in the progenitor molecules serve as potential chimerization points in the assembly of the progeny molecules.

Typically a serviceable demarcation point is an area of homology (comprised of at least one homologous nucleotide base) shared by at least two progenitor templates, but the demarcation point can be an area of homology that is shared by at least half of the progenitor templates, at least two thirds of the progenitor templates, at least three fourths of the progenitor templates and in one aspect at almost all of the progenitor templates. Even more in one aspect still a serviceable demarcation point is an area of homology that is shared by all of the progenitor templates.

In a one aspect, the gene reassembly process is performed exhaustively in order to generate an exhaustive library. In other words, all possible ordered combinations of the nucleic acid building blocks are represented in the set of finalized chimeric nucleic acid molecules. At the same time, the assembly order (i.e. the order of assembly of each building block in the 5' to 3 sequence of each finalized chimeric nucleic acid) in each combination is by design (or non-stochastic). Because of the non-stochastic nature of the method, the possibility of unwanted side products is greatly reduced.

In another aspect, the method provides that the gene reassembly process is performed systematically, for example to generate a systematically compartmentalized library, with compartments that can be screened systematically, e.g., one by one. In other words the invention provides that, through the selective and judicious use of specific nucleic acid building blocks, coupled with the selective and judicious use of sequentially stepped assembly reactions, an experimental design can be achieved where specific sets of progeny products are made in each of several reaction vessels. This allows a systematic examination and screening procedure to be performed. Thus, it allows a potentially very large number of progeny molecules to be examined systematically in smaller groups.

Because of its ability to perform chimerizations in a manner that is highly flexible yet exhaustive and systematic as well, particularly when there is a low level of homology among the progenitor molecules, the instant invention provides for the generation of a library (or set) comprised of a large number of progeny molecules. Because of the non-stochastic nature of the instant gene reassembly invention, the progeny molecules generated in one aspect comprise a library of finalized chimeric nucleic acid molecules having an overall assembly order that is chosen by design. In a particularly aspect, such a generated library is comprised of greater than $10^3$ to greater than $10^{1000}$ different progeny molecular species.

In one aspect, a set of finalized chimeric nucleic acid molecules, produced as described is comprised of a polynucleotide encoding a polypeptide. According to one aspect, this polynucleotide is a gene, which may be a man-made gene. According to another aspect, this polynucleotide is a gene pathway, which may be a man-made gene pathway. The invention provides that one or more man-made genes generated by the invention may be incorporated into a man-made gene pathway, such as pathway operable in a eukaryotic organism (including a plant).

In another exemplification, the synthetic nature of the step in which the building blocks are generated allows the design and introduction of nucleotides (e.g., one or more nucleotides, which may be, for example, codons or introns or regulatory sequences) that can later be optionally removed in an in vitro process (e.g., by mutagenesis) or in an in vivo process (e.g., by utilizing the gene splicing ability of a host organism). It is appreciated that in many instances the introduction of these nucleotides may also be desirable for many other reasons in addition to the potential benefit of creating a serviceable demarcation point.

Thus, according to another aspect, the invention provides that a nucleic acid building block can be used to introduce an intron. Thus, the invention provides that functional introns may be introduced into a man-made gene of the invention. The invention also provides that functional introns may be introduced into a man-made gene pathway of the invention. Accordingly, the invention provides for the generation of a chimeric polynucleotide that is a man-made gene containing one (or more) artificially introduced intron(s).

Accordingly, the invention also provides for the generation of a chimeric polynucleotide that is a man-made gene pathway containing one (or more) artificially introduced intron(s). In one aspect, the artificially introduced intron(s) are functional in one or more host cells for gene splicing much in the way that naturally-occurring introns serve functionally in gene splicing. The invention provides a process of producing man-made intron-containing polynucleotides to be introduced into host organisms for recombination and/or splicing.

A man-made gene produced using the invention can also serve as a substrate for recombination with another nucleic acid. Likewise, a man-made gene pathway produced using the invention can also serve as a substrate for recombination with another nucleic acid. In one aspect, the recombination is facilitated by, or occurs at, areas of homology between the man-made, intron-containing gene and a nucleic acid, which serves as a recombination partner. In one aspect, the recombination partner may also be a nucleic acid generated by the invention, including a man-made gene or a man-made gene pathway. Recombination may be facilitated by or may occur at areas of homology that exist at the one (or more) artificially introduced intron(s) in the man-made gene.

The synthetic gene reassembly method of the invention utilizes a plurality of nucleic acid building blocks, each of which in one aspect has two ligatable ends. The two ligatable ends on each nucleic acid building block may be two blunt ends (i.e. each having an overhang of zero nucleotides), or in one aspect one blunt end and one overhang, or more in one aspect still two overhangs.

A useful overhang for this purpose may be a 3' overhang or a 5' overhang. Thus, a nucleic acid building block may have a 3' overhang or alternatively a 5' overhang or alternatively two 3' overhangs or alternatively two 5' overhangs. The overall order in which the nucleic acid building blocks are assembled to form a finalized chimeric nucleic acid molecule is determined by purposeful experimental design and is not random.

hi one aspect, a nucleic acid building block is generated by chemical synthesis of two single-stranded nucleic acids (also referred to as single-stranded oligos) and contacting them so as to allow them to anneal to form a double-stranded nucleic acid building block.

A double-stranded nucleic acid building block can be of variable size. The sizes of these building blocks can be small or large. Exemplary sizes for building block range from 1 base pair (not including any overhangs) to 100,000 base pairs (not including any overhangs). Other exemplary size ranges are also provided, which have lower limits of from 1 bp to 10,000 bp (including every integer value in between) and upper limits of from 2 bp to 100,000 bp (including every integer value in between).

Many methods exist by which a double-stranded nucleic acid building block can be generated that is serviceable for the invention; and these are known in the art and can be readily performed by the skilled artisan.

According to one aspect, a double-stranded nucleic acid building block is generated by first generating two single stranded nucleic acids and allowing them to anneal to form a double-stranded nucleic acid building block. The two strands of a double-stranded nucleic acid building block may be complementary at every nucleotide apart from any that form an overhang; thus containing no mismatches, apart from any overhang(s). According to another aspect, the two strands of a double-stranded nucleic acid building block are complementary at fewer than every nucleotide apart from any that form an overhang. Thus, according to this aspect, a double-stranded nucleic acid building block can be used to introduce codon degeneracy. In one aspect the codon degeneracy is introduced using the site-saturation mutagenesis described herein, using one or more $N_5N,G/T$ cassettes or alternatively using one or more $N,N_5N$ cassettes.

The in vivo recombination method of the invention can be performed blindly on a pool of unknown hybrids or alleles of a specific polynucleotide or sequence. However, it is not necessary to know the actual DNA or RNA sequence of the specific polynucleotide.

The approach of using recombination within a mixed population of genes can be useful for the generation of any useful proteins, for example, interleukin I, antibodies, tPA and growth hormone. This approach may be used to generate proteins having altered specificity or activity. The approach may also be useful for the generation of hybrid nucleic acid sequences, for example, promoter regions, introns, exons, enhancer sequences, 31 untranslated regions or 51 untranslated regions of genes. Thus this approach may be used to generate genes having increased rates of expression. This approach may also be useful in the study of repetitive DNA sequences. Finally, this approach may be useful to mutate ribozymes or aptamers.

In one aspect the invention described herein is directed to the use of repeated cycles of reductive reassortment, recombination and selection which allow for the directed molecular evolution of highly complex linear sequences, such as DNA, RNA or proteins thorough recombination.

Optimized Directed Evolution System

The invention provides a non-stochastic gene modification system termed "optimized directed evolution system" to generate polypeptides, e.g., ammonia lyase, e.g., phenylalanine ammonia lyase, tyrosine ammonia lyase and/or histidine ammonia lyase enzymes or antibodies of the invention, with new or altered properties. Optimized directed evolution is directed to the use of repeated cycles of reductive reassortment, recombination and selection that allow for the directed molecular evolution of nucleic acids through recombination. Optimized directed evolution allows generation of a large population of evolved chimeric sequences, wherein the generated population is significantly enriched for sequences that have a predetermined number of crossover events.

A crossover event is a point in a chimeric sequence where a shift in sequence occurs from one parental variant to another parental variant. Such a point is normally at the juncture of where oligonucleotides from two parents are ligated together to form a single sequence. This method allows calculation of the correct concentrations of oligonucleotide sequences so that the final chimeric population of sequences is enriched for the chosen number of crossover events. This provides more control over choosing chimeric variants having a predetermined number of crossover events.

In addition, this method provides a convenient means for exploring a tremendous amount of the possible protein variant space in comparison to other systems. Previously, if one generated, for example, $10^{13}$ chimeric molecules during a reaction, it would be extremely difficult to test such a high number of chimeric variants for a particular activity. Moreover, a significant portion of the progeny population would have a very high number of crossover events which resulted in proteins that were less likely to have increased levels of a particular activity. By using these methods, the population of chimerics molecules can be enriched for those variants that have a particular number of crossover events. Thus, although one can still generate $10^{13}$ chimeric molecules during a reaction, each of the molecules chosen for further analysis most likely has, for example, only three crossover events. Because the resulting progeny population can be skewed to have a predetermined number of crossover events, the boundaries on the functional variety between the chimeric molecules is reduced. This provides a more manageable number of variables when calculating which oligonucleotide from the original parental polynucleotides might be responsible for affecting a particular trait.

One method for creating a chimeric progeny polynucleotide sequence is to create oligonucleotides corresponding to fragments or portions of each parental sequence. Each oligonucleotide in one aspect includes a unique region of overlap so that mixing the oligonucleotides together results in a new variant that has each oligonucleotide fragment assembled in the correct order. Alternatively protocols for practicing these methods of the invention can be found in U.S. Pat. Nos. 6,773,900; 6,740,506; 6,713,282; 6,635,449; 6,605,449; 6,537,776; 6,361,974.

The number of oligonucleotides generated for each parental variant bears a relationship to the total number of resulting crossovers in the chimeric molecule that is ultimately created.

For example, three parental nucleotide sequence variants might be provided to undergo a ligation reaction in order to find a chimeric variant having, for example, greater activity at high temperature. As one example, a set of 50 oligonucleotide sequences can be generated corresponding to each portions of each parental variant. Accordingly, during the ligation reassembly process there could be up to 50 crossover events within each of the chimeric sequences. The probability that each of the generated chimeric polynucleotides will contain oligonucleotides from each parental variant in alternating order is very low. If each oligonucleotide fragment is present in the ligation reaction in the same molar quantity it is likely that in some positions oligonucleotides from the same parental polynucleotide will ligate next to one another and thus not result in a crossover event. If the concentration of each oligonucleotide from each parent is kept constant during any ligation step in this example, there is a ⅓ chance (assuming 3 parents) that an oligonucleotide from the same parental variant will ligate within the chimeric sequence and produce no crossover.

Accordingly, a probability density function (PDF) can be determined to predict the population of crossover events that are likely to occur during each step in a ligation reaction given a set number of parental variants, a number of oligonucleotides corresponding to each variant, and the concentrations of each variant during each step in the ligation reaction. The statistics and mathematics behind determining the PDF is described below. By utilizing these methods, one can calculate such a probability density function, and thus enrich the chimeric progeny population for a predetermined number of crossover events resulting from a particular ligation reaction. Moreover, a target number of crossover events can be predetermined, and the system then programmed to calculate the starting quantities of each parental oligonucleotide during each step in the ligation reaction to result in a probability density function that centers on the predetermined number of crossover events. These methods are directed to the use of repeated cycles of reductive reassortment, recombination and selection that allow for the directed molecular evolution of a nucleic acid encoding a polypeptide through recombination. This system allows generation of a large population of evolved chimeric sequences, wherein the generated population is significantly enriched for sequences that have a predetermined number of crossover events. A crossover event is a point in a chimeric sequence where a shift in sequence occurs from one parental variant to another parental variant. Such a point is normally at the juncture of where oligonucleotides from two parents are ligated together to form a single sequence. The method allows calculation of the correct concentrations of oligonucleotide sequences so that the final chimeric population of sequences is enriched for the chosen number of crossover events. This provides more control over choosing chimeric variants having a predetermined number of crossover events.

In addition, these methods provide a convenient means for exploring a tremendous amount of the possible protein variant space in comparison to other systems. By using the methods described herein, the population of chimerics molecules can be enriched for those variants that have a particular number of crossover events. Thus, although one can still generate $10^{13}$ chimeric molecules during a reaction, each of the molecules chosen for further analysis most likely has, for example, only three crossover events. Because the resulting progeny population can be skewed to have a predetermined number of crossover events, the boundaries on the functional variety between the chimeric molecules is reduced. This provides a more manageable number of variables when calculating which oligonucleotide from the original parental polynucleotides might be responsible for affecting a particular trait.

In one aspect, the method creates a chimeric progeny polynucleotide sequence by creating oligonucleotides corresponding to fragments or portions of each parental sequence. Each oligonucleotide in one aspect includes a unique region of overlap so that mixing the oligonucleotides together results in a new variant that has each oligonucleotide fragment assembled in the correct order. See also U.S. Pat. Nos. 6,773,900; 6,740,506; 6,713,282; 6,635,449; 6,605,449; 6,537,776; 6,361,974.

Determining Crossover Events

Aspects of the invention include a system and software that receive a desired crossover probability density function (PDF), the number of parent genes to be reassembled, and the number of fragments in the reassembly as inputs. The output of this program is a "fragment PDF" that can be used to determine a recipe for producing reassembled genes, and the estimated crossover PDF of those genes. The processing described herein is in one aspect performed in MATLAB™ (The Mathworks, Natick, Massachusetts) a programming language and development environment for technical computing.

Iterative Processes

In practicing the invention, these processes can be iteratively repeated. For example, a nucleic acid (or, the nucleic acid) responsible for an altered or new ammonia lyase, e.g., phenylalanine ammonia lyase, tyrosine ammonia lyase and/or histidine ammonia lyase enzyme phenotype is identified, re-isolated, again modified, re-tested for activity. This process can be iteratively repeated until a desired phenotype is engineered. For example, an entire biochemical anabolic or catabolic pathway can be engineered into a cell, including, e.g., ammonia lyase, e.g., phenylalanine ammonia lyase, tyrosine ammonia lyase and/or histidine ammonia lyase enzyme activity.

Similarly, if it is determined that a particular oligonucleotide has no affect at all on the desired trait (e.g., a new ammonia lyase, e.g., phenylalanine ammonia lyase, tyrosine ammonia lyase and/or histidine ammonia lyase enzyme phenotype), it can be removed as a variable by synthesizing larger parental oligonucleotides that include the sequence to be removed. Since incorporating the sequence within a larger sequence prevents any crossover events, there will no longer be any variation of this sequence in the progeny polynucleotides. This iterative practice of determining which oligonucleotides are most related to the desired trait, and which are unrelated, allows more efficient exploration all of the possible protein variants that might be provide a particular trait or activity.

In Vivo Shuffling

In vivo shuffling of molecules is use in methods of the invention that provide variants of polypeptides of the invention, e.g., antibodies, ammonia lyase, e.g., phenylalanine ammonia lyase, tyrosine ammonia lyase and/or histidine ammonia lyase enzymes, and the like. In vivo shuffling can be performed utilizing the natural property of cells to recombine multimers. While recombination in vivo has provided the major natural route to molecular diversity, genetic recombination remains a relatively complex process that involves 1) the recognition of homologies; 2) strand cleavage, strand invasion, and metabolic steps leading to the production of recombinant chiasma; and finally 3) the resolution of chiasma into discrete recombined molecules. The formation of the chiasma requires the recognition of homologous sequences.

In another aspect, the invention includes a method for producing a hybrid polynucleotide from at least a first polynucleotide and a second polynucleotide. The invention can be used to produce a hybrid polynucleotide by introducing at least a first polynucleotide and a second polynucleotide (e.g., one, or both, being an exemplary ammonia lyase, e.g., phenylalanine ammoniac lyase, histidine ammonia lyase and/or tyrosine ammonia lyase, enzyme-encoding sequence of the invention) which share at least one region of partial sequence homology into a suitable host cell. The regions of partial sequence homology promote processes which result in sequence reorganization producing a hybrid polynucleotide. The term "hybrid polynucleotide", as used herein, is any nucleotide sequence which results from the method of the present invention and contains sequence from at least two original polynucleotide sequences. Such hybrid polynucleotides can result from intermolecular recombination events which promote sequence integration between DNA molecules. In addition, such hybrid polynucleotides can result from intramolecular reductive reassortment processes which utilize repeated sequences to alter a nucleotide sequence within a DNA molecule.

In vivo reassortment is focused on "inter-molecular" processes collectively referred to as "recombination" which in bacteria, is generally viewed as a "RecA-dependent" phenomenon. The invention can rely on recombination processes of a host cell to recombine and re-assort sequences, or the cells' ability to mediate reductive processes to decrease the complexity of quasi-repeated sequences in the cell by deletion. This process of "reductive reassortment" occurs by an "intra-molecular", RecA-independent process.

Therefore, in another aspect of the invention, novel polynucleotides can be generated by the process of reductive reassortment. The method involves the generation of constructs containing consecutive sequences (original encoding sequences), their insertion into an appropriate vector and their subsequent introduction into an appropriate host cell. The reassortment of the individual molecular identities occurs by combinatorial processes between the consecutive sequences in the construct possessing regions of homology, or between quasi-repeated units. The reassortment process recombines and/or reduces the complexity and extent of the repeated sequences and results in the production of novel molecular species. Various treatments may be applied to enhance the rate of reassortment. These could include treatment with ultra-violet light, or DNA damaging chemicals and/or the use of host cell lines displaying enhanced levels of "genetic instability". Thus the reassortment process may involve homologous recombination or the natural property of quasi-repeated sequences to direct their own evolution.

Repeated or "quasi-repeated" sequences play a role in genetic instability. In the present invention, "quasi-repeats" are repeats that are not restricted to their original unit structure. Quasi-repeated units can be presented as an array of sequences in a construct; consecutive units of similar sequences. Once ligated, the junctions between the consecutive sequences become essentially invisible and the quasi-repetitive nature of the resulting construct is now continuous at the molecular level. The deletion process the cell performs to reduce the complexity of the resulting construct operates between the quasi-repeated sequences. The quasi-repeated units provide a practically limitless repertoire of templates upon which slippage events can occur. The constructs containing the quasi-repeats thus effectively provide sufficient molecular elasticity that deletion (and potentially insertion) events can occur virtually anywhere within the quasi-repetitive units.

When the quasi-repeated sequences are all ligated in the same orientation, for instance head to tail or vice versa, the cell cannot distinguish individual units. Consequently, the reductive process can occur throughout the sequences. In contrast, when for example, the units are presented head to head, rather than head to tail, the inversion delineates the endpoints of the adjacent unit so that deletion formation will favor the loss of discrete units. Thus, it is preferable with the present method that the sequences are in the same orientation. Random orientation of quasi-repeated sequences will result in the loss of reassortment efficiency, while consistent orientation of the sequences will offer the highest efficiency. However, while having fewer of the contiguous sequences in the same orientation decreases the efficiency, it may still provide sufficient elasticity for the effective recovery of novel molecules. Constructs can be made with the quasi-repeated sequences in the same orientation to allow higher efficiency.

Sequences can be assembled in a head to tail orientation using any of a variety of methods, including the following:
a) Primers that include a poly-A head and poly-T tail which when made single-stranded would provide orientation can be utilized. This is accomplished by having the first few bases of the primers made from RNA and hence easily removed RNaseH.
b) Primers that include unique restriction cleavage sites can be utilized. Multiple sites, a battery of unique sequences and repeated synthesis and ligation steps would be required.
c) The inner few bases of the primer could be thiolated and an exonuclease used to produce properly tailed molecules.

The recovery of the re-assorted sequences relies on the identification of cloning vectors with a reduced repetitive index (RI). The re-assorted encoding sequences can then be recovered by amplification. The products are re-cloned and expressed. The recovery of cloning vectors with reduced RI can be affected by:
1) The use of vectors only stably maintained when the construct is reduced in complexity.
2) The physical recovery of shortened vectors by physical procedures. In this case, the cloning vector would be recovered using standard plasmid isolation procedures and size fractionated on either an agarose gel, or column with a low molecular weight cut off utilizing standard procedures.
3) The recovery of vectors containing interrupted genes which can be selected when insert size decreases.
4) The use of direct selection techniques with an expression vector and the appropriate selection.

Encoding sequences (for example, genes) from related organisms may demonstrate a high degree of homology and encode quite diverse protein products. These types of sequences are particularly useful in the present invention as quasi-repeats. However, while the examples illustrated below demonstrate the reassortment of nearly identical original encoding sequences (quasi-repeats), this process is not limited to such nearly identical repeats.

The following example demonstrates a method of the invention. Encoding nucleic acid sequences (quasi-repeats) derived from three (3) unique species are described. Each sequence encodes a protein with a distinct set of properties. Each of the sequences differs by a single or a few base pairs at a unique position in the sequence. The quasi-repeated sequences are separately or collectively amplified and ligated into random assemblies such that all possible permutations and combinations are available in the population of ligated molecules. The number of quasi-repeat units can be controlled by the assembly conditions. The average number of quasi-repeated units in a construct is defined as the repetitive index (RI).

Once formed, the constructs may, or may not be size fractionated on an agarose gel according to published protocols, inserted into a cloning vector and transfected into an appropriate host cell. The cells are then propagated and "reductive reassortment" is effected. The rate of the reductive reassortment process may be stimulated by the introduction of DNA damage if desired. Whether the reduction in RI is mediated by deletion formation between repeated sequences by an "intra-molecular" mechanism, or mediated by recombination-like events through "inter-molecular" mechanisms is immaterial. The end result is a reassortment of the molecules into all possible combinations.

Optionally, the method comprises the additional step of screening the library members of the shuffled pool to identify individual shuffled library members having the ability to bind or otherwise interact, or catalyze a particular reaction (e.g., such as catalytic domain of an enzyme) with a predetermined macromolecule, such as for example a proteinaceous receptor, an oligosaccharide, virion, or other predetermined compound or structure.

The polypeptides that are identified from such libraries can be used for therapeutic, diagnostic, research and related purposes (e.g., catalysts, solutes for increasing osmolality of an aqueous solution and the like) and/or can be subjected to one or more additional cycles of shuffling and/or selection.

In another aspect, it is envisioned that prior to or during recombination or reassortment, polynucleotides generated by the method of the invention can be subjected to agents or processes which promote the introduction of mutations into the original polynucleotides. The introduction of such mutations would increase the diversity of resulting hybrid polynucleotides and polypeptides encoded therefrom. The agents or processes which promote mutagenesis can include, but are not limited to: (+)-CC-1065, or a synthetic analog such as (+)-CC-1065-(N3-Adenine {See Sun and Hurley, (1992); an N-acetylated or deacetylated 4'-fluoro-4-aminobiphenyl adduct capable of inhibiting DNA synthesis {See, for example, van de Poll et al. (1992)); or a N-acetylated or deacetylated 4-aminobiphenyl adduct capable of inhibiting DNA synthesis {See also, van de Poll et al. (1992), pp. 751-758); trivalent chromium, a trivalent chromium salt, a polycyclic aromatic hydrocarbon (PAH) DNA adduct capable of inhibiting DNA replication, such as 7-bromomethyl-benz[α] anthracene ("BMA"), tris(2,3-dibromopropyl)phosphate ("Tris-BP"), 1,2-dibromo-3-chloropropane ("DBCP"), 2-bromoacrolein (2BA), benzo[α]pyrene-7,8-dihydrodiol-9-10-epoxide ("BPDE"), a platinum(II) halogen salt, N-hydroxy-2-amino-3-methylimidazo[4,5-/J-quinoline ("N-hydroxy-IQ") and N-hydroxy-2-amino-1-methyl-6-phenylimidazo[4,5-/J-pyridine ("N-hydroxy-PhIP"). Exemplary means for slowing or halting PCR amplification consist of UV light (+)—CC-1065 and (+)—CC-1065-(N3-Adenine). Particularly encompassed means are DNA adducts or polynucleotides comprising the DNA adducts from the polynucleotides or polynucleotides pool, which can be released or removed by a process including heating the solution comprising the polynucleotides prior to further processing.

In another aspect the invention is directed to a method of producing recombinant proteins having biological activity by treating a sample comprising double-stranded template polynucleotides encoding a wild-type protein under conditions according to the invention which provide for the production of hybrid or re-assorted polynucleotides.

Producing Sequence Variants

The invention also provides additional methods for making sequence variants of the nucleic acid (e.g., ammonia lyase, e.g., phenylalanine ammonia lyase, tyrosine ammonia lyase and/or histidine ammonia lyase enzyme) sequences of the invention. The invention also provides additional methods for isolating ammonia lyase, e.g., phenylalanine ammonia lyase, tyrosine ammonia lyase and/or histidine ammonia lyase enzymes using the nucleic acids and polypeptides of the invention. In one aspect, the invention provides for variants of an ammonia lyase, e.g., phenylalanine ammonia lyase, tyrosine ammonia lyase and/or histidine ammonia lyase enzyme coding sequence (e.g., a gene, cDNA or message) of the invention, which can be altered by any means, including, e.g., random or stochastic methods, or, non-stochastic, or "directed evolution," methods, as described above.

The isolated variants may be naturally occurring. Variant can also be created in vitro. Variants maybe created using genetic engineering techniques such as site directed mutagenesis, random chemical mutagenesis, Exonuclease III deletion procedures, and standard cloning techniques. Alternatively, such variants, fragments, analogs, or derivatives may be created using chemical synthesis or modification procedures. Other methods of making variants are also familiar to those skilled in the art. These include procedures in which nucleic acid sequences obtained from natural isolates are modified to generate nucleic acids which encode polypeptides having characteristics which enhance their value in industrial or laboratory applications, hi such procedures, a large number of variant sequences having one or more nucleotide differences with respect to the sequence obtained from the natural isolate are generated and characterized. These nucleotide differences can result in amino acid changes with respect to the polypeptides encoded by the nucleic acids from the natural isolates.

For example, variants may be created using error prone PCR. In error prone PCR, PCR is performed under conditions where the copying fidelity of the DNA polymerase is low, such that a high rate of point mutations is obtained along the entire length of the PCR product. Error prone PCR is described, e.g., in Leung (1989) Technique 1:11-15) and Caldwell (1992) PCR Methods Applic. 2:28-33. Briefly, in such procedures, nucleic acids to be mutagenized are mixed with PCR primers, reaction buffer, $MgCl_2$, $MnCl_2$, Taq polymerase and an appropriate concentration of dNTPs for achieving a high rate of point mutation along the entire length of the PCR product. For example, the reaction may be performed using 20 fmoles of nucleic acid to be mutagenized, 30 pmole of each PCR primer, a reaction buffer comprising 50 mM KCl, 10 mM Tris HCl (pH 8.3) and 0.01% gelatin, 7 mM $MgCl_2$, 0.5 mM $MnCl_2$, 5 units of Taq polymerase, 0.2 mM dGTP, 0.2 mM dATP, 1 mM dCTP, and 1 mM dTTP. PCR may be performed for 30 cycles of 94° C. for 1 min, 45° C. for 1 min, and 72° C. for 1 min. However, it will be appreciated that these parameters may be varied as appropriate. The mutagenized nucleic acids are cloned into an appropriate vector and the activities of the polypeptides encoded by the mutagenized nucleic acids are evaluated.

Variants may also be created using oligonucleotide directed mutagenesis to generate site-specific mutations in any cloned DNA of interest. Oligonucleotide mutagenesis is described, e.g., in Reidhaar-Olson (1988) Science 241:53-57. Briefly, in such procedures a plurality of double stranded oligonucleotides bearing one or more mutations to be introduced into the cloned DNA are synthesized and inserted into the cloned DNA to be mutagenized. Clones containing the mutagenized DNA are recovered and the activities of the polypeptides they encode are assessed.

Another method for generating variants is assembly PCR. Assembly PCR involves the assembly of a PCR product from a mixture of small DNA fragments. A large number of different PCR reactions occur in parallel in the same vial, with the products of one reaction priming the products of another reaction. Assembly PCR is described in, e.g., U.S. Pat. No. 5,965,408.

Still another method of generating variants is sexual PCR mutagenesis. In sexual PCR mutagenesis, forced homologous recombination occurs between DNA molecules of different but highly related DNA sequence in vitro, as a result of random fragmentation of the DNA molecule based on sequence homology, followed by fixation of the crossover by primer extension in a PCR reaction. Sexual PCR mutagenesis is described, e.g., in Stemmer (1994) Proc. Natl. Acad. Sci. USA 91:10747-10751. Briefly, in such procedures a plurality of nucleic acids to be recombined are digested with DNase to generate fragments having an average size of 50-200 nucleotides. Fragments of the desired average size are purified and resuspended in a PCR mixture. PCR is conducted under conditions which facilitate recombination between the nucleic acid fragments. For example, PCR may be performed by resuspending the purified fragments at a concentration of 10-30 ng/µl in a solution of 0.2 mM of each dNTP, 2.2 mM $MgCl_2$, 50 mM KCL, 10 mM Tris HCl, pH 9.0, and 0.1% Triton X-100. 2.5 units of Taq polymerase per 100:1 of reaction mixture is added and PCR is performed using the following regime: 94° C. for 60 seconds, 94° C. for 30 seconds, 50-55° C. for 30 seconds, 72° C. for 30 seconds (30-45 times) and 72° C. for 5 minutes. However, it will be appreciated that these parameters may be varied as appropriate. In some aspects, oligonucleotides may be included in the PCR reactions, hi other aspects, the Klenow fragment of DNA polymerase I may be used in a first set of PCR reactions and Taq polymerase may be used in a subsequent set of PCR reactions. Recombinant sequences are isolated and the activities of the polypeptides they encode are assessed.

Variants may also be created by in vivo mutagenesis, hi some aspects, random mutations in a sequence of interest are generated by propagating the sequence of interest in a bacterial strain, such as an *E. coli* strain, which carries mutations in one or more of the DNA repair pathways. Such "mutator" strains have a higher random mutation rate than that of a wild-type parent. Propagating the DNA in one of these strains will eventually generate random mutations within the DNA. Mutator strains suitable for use for in vivo mutagenesis are described in PCT Publication No. WO 91/16427, published Oct. 31, 1991, entitled "Methods for Phenotype Creation from Multiple Gene Populations".

Variants may also be generated using cassette mutagenesis. In cassette mutagenesis a small region of a double stranded DNA molecule is replaced with a synthetic oligonucleotide "cassette" that differs from the native sequence. The oligonucleotide often contains completely and/or partially randomized native sequence.

Recursive ensemble mutagenesis may also be used to generate variants. Recursive ensemble mutagenesis is an algorithm for protein engineering (protein mutagenesis) developed to produce diverse populations of pheno typically related mutants whose members differ in amino acid sequence. This method uses a feedback mechanism to control successive rounds of combinatorial cassette mutagenesis. Recursive ensemble mutagenesis is described, e.g., in Arkin (1992) Proc. Natl. Acad. Sci. USA 89:7811-7815.

In some aspects, variants are created using exponential ensemble mutagenesis. Exponential ensemble mutagenesis is a process for generating combinatorial libraries with a high percentage of unique and functional mutants, wherein small groups of residues are randomized in parallel to identify, at each altered position, amino acids which lead to functional proteins. Exponential ensemble mutagenesis is described, e.g., in Delegrave (1993) Biotechnology Res. 11:1 548-1552. Random and site-directed mutagenesis are described, e.g., in Arnold (1993) Current Opinion in Biotechnology 4:450-455.

In some aspects, the variants are created using shuffling procedures wherein portions of a plurality of nucleic acids which encode distinct polypeptides are fused together to create chimeric nucleic acid sequences which encode chimeric polypeptides as described in U.S. Pat. No. 5,965,408, filed Jul. 9, 1996, entitled, "Method of DNA Reassembly by Interrupting Synthesis" and U.S. Pat. No. 5,939,250, filed May 22, 1996, entitled, "Production of Enzymes Having Desired Activities by Mutagenesis.

The variants of the polypeptides of the invention may be variants in which one or more of the amino acid residues of the polypeptides of the sequences of the invention are substituted with a conserved or non-conserved amino acid residue (in one aspect a conserved amino acid residue) and such substituted amino acid residue may or may not be one encoded by the genetic code.

Conservative substitutions are those that substitute a given amino acid in a polypeptide by another amino acid of like characteristics. Typically seen as conservative substitutions are the following replacements: replacements of an aliphatic amino acid such as Alanine, Valine, Leucine and Isoleucine with another aliphatic amino acid; replacement of a Serine with a Threonine or vice versa; replacement of an acidic residue such as Aspartic acid and Glutamic acid with another acidic residue; replacement of a residue bearing an amide group, such as Asparagine and Glutamine, with another residue bearing an amide group; exchange of a basic residue such as Lysine and Arginine with another basic residue; and replacement of an aromatic residue such as Phenylalanine, Tyrosine with another aromatic residue. Other variants are those in which one or more of the amino acid residues of a polypeptide of the invention includes a substituent group.

In one aspect, a conservative substitution is a substitution of one amino acid for another amino acid in a polypeptide, which substitution has little to no impact on the structure and/or activity (including binding and/or enzymatic activity) of the polypeptide. The substitution is considered conservative independent of whether the exchanged amino acids appear structurally or functionally similar. For example, ideally, a lyase polypeptide including one or more conservative substitutions retains lyase activity. A polypeptide can be produced to contain one or more conservative substitutions by manipulating the nucleotide sequence that encodes that polypeptide using, for example, standard procedures such as site-directed mutagenesis or PCR or other methods known to those in the art.

Non-limiting examples of amino acids which may be substituted for an original amino acid in a protein and which may be regarded as conservative substitutions if there is little to no impact on the activity of the polypeptide include: Ala substituted with ser or thr; arg substituted with gin, his, or lys; asn substituted with glu, gin, lys, his, asp; asp substituted with asn, glu, or gin; cys substituted with ser or ala; gin substituted with asn, glu, lys, his, asp, or arg; glu substituted with asn, gin lys, or asp; gly substituted with pro; his substituted with asn, lys, gin, arg, tyr; ile substituted with leu, met, val, phe; leu substituted with ile, met, val, phe; lys substituted with asn, glu, gin, his, arg; met substituted with ile, leu, val, phe; phe substituted with trp, tyr, met, ile, or leu; ser substituted with thr, ala; thr substituted with ser or ala; trp substituted with phe, tyr; tyr substituted with his, phe, or trp; and val substituted with met, ile, leu.

Further information about conservative substitutions can be found in, among other locations, Ben-Bassat et al, (*J. Bacteriol.* 169:751-7, 1987), O'Regan et al, {*Gene* 77:237-51, 1989), Sahin-Toth et al, (*Protein ScL* 3:240-7, 1994), Hochuli et al, (Bio/Technology 6:1321-5, 1988), WO 00/67796 (Curd et al.) and in standard textbooks of genetics and molecular biology.

Still other variants are those in which the polypeptide is associated with another compound, such as a compound to increase the half-life of the polypeptide (for example, polyethylene glycol).

Additional variants are those in which additional amino acids are fused to the polypeptide, such as a leader sequence, a secretory sequence, a proprotein sequence or a sequence which facilitates purification, enrichment, or stabilization of the polypeptide.

In some aspects, the fragments, derivatives and analogs retain the same biological function or activity as the polypeptides of the invention. In other aspects, the fragment, derivative, or analog includes a proprotein, such that the fragment, derivative, or analog can be activated by cleavage of the proprotein portion to produce an active polypeptide.

Optimizing Codons to Achieve High Levels of Protein Expression in Host Cells

The invention provides methods for modifying ammonia lyase, e.g., phenylalanine ammonia lyase, tyrosine ammonia lyase and/or histidine ammonia lyase, enzyme-encoding nucleic acids to modify codon usage. In one aspect, the invention provides methods for modifying codons in a nucleic acid encoding an ammonia lyase, e.g., phenylalanine ammonia lyase, tyrosine ammonia lyase and/or histidine ammonia lyase enzyme to increase or decrease its expression in a host cell. The invention also provides nucleic acids encoding an ammonia lyase, e.g., phenylalanine ammonia lyase, tyrosine ammonia lyase and/or histidine ammonia lyase enzyme modified to increase its expression in a host cell, ammonia lyase, e.g., phenylalanine ammonia lyase, tyrosine ammonia lyase and/or histidine ammonia lyase enzyme so modified, and methods of making the modified ammonia lyase, e.g., phenylalanine ammonia lyase, tyrosine ammonia lyase and/or histidine ammonia lyase enzymes. The method comprises identifying a "non-preferred" or a "less preferred" codon in ammonia lyase, e.g., phenylalanine ammonia lyase, tyrosine ammonia lyase and/or histidine ammonia lyase, enzyme-encoding nucleic acid and replacing one or more of these non-preferred or less preferred codons with a "preferred codon" encoding the same amino acid as the replaced codon and at least one non-preferred or less preferred codon in the nucleic acid has been replaced by a preferred codon encoding the same amino acid. A preferred codon is a codon over-represented in coding sequences in genes in the host cell and a non-preferred or less preferred codon is a codon under-represented in coding sequences in genes in the host cell.

Host cells for expressing the nucleic acids, expression cassettes and vectors of the invention include bacteria, yeast, fungi, plant cells, insect cells and mammalian cells. Thus, the invention provides methods for optimizing codon usage in all of these cells, codon-altered nucleic acids and polypeptides made by the codon-altered nucleic acids. Exemplary host cells include gram negative bacteria, such as *Escherichia coli*; gram positive bacteria, such as *Streptomyces* sp., *Lactobacillus gasseri*, *Lactococcus lactis*, *Lactococcus cremoris*, *Bacillus subtilis*, *Bacillus cereus*. Exemplary host cells also include eukaryotic organisms, e.g., various yeast, such as *Saccharomyces* sp., including *Saccharomyces cerevisiae*, *Schizosaccharomyces pombe*, *Pichia pastoris*, and *Kluyveromyces lactis*, *Hansenula polymorpha*, *Aspergillus niger*, and mammalian cells and cell lines and insect cells and cell lines. Thus, the invention also includes nucleic acids and polypeptides optimized for expression in these organisms and species.

For example, the codons of a nucleic acid encoding an ammonia lyase, e.g., phenylalanine ammonia lyase, tyrosine ammonia lyase and/or histidine ammonia lyase enzyme isolated from a bacterial cell are modified such that the nucleic acid is optimally expressed in a bacterial cell different from the bacteria from which the ammonia lyase, e.g., phenylalanine ammonia lyase, tyrosine ammonia lyase and/or histidine ammonia lyase enzyme was derived, a yeast, a fungi, a plant cell, an insect cell or a mammalian cell. Methods for optimizing codons are well known in the art, see, e.g., U.S. Pat. No. 5,795,737; Baca (2000) Int. J. Parasitol. 30:1 13-1 18; Hale (1998) Protein Expr. Purif. 12:185-188; Narum (2001) Infect. Immun. 69:7250-7253. See also Narum (2001) Infect. Immun. 69:7250-7253, describing optimizing codons in mouse systems; Outchkourov (2002) Protein Expr. Purif. 24:18-24, describing optimizing codons in yeast; Feng (2000) Biochemistry 39:15399-15409, describing optimizing codons in *E. coli*; Humphreys (2000) Protein Expr. Purif. 20:252-264, describing optimizing codon usage that affects secretion in *E. coli*.

Transgenic Non-Human Animals

The invention provides transgenic non-human animals comprising a nucleic acid, a polypeptide (e.g., an ammonia lyase, e.g., phenylalanine ammonia lyase, tyrosine ammonia lyase and/or histidine ammonia lyase enzyme), an expression cassette or vector or a transfected or transformed cell of the invention. The invention also provides methods of making and using these transgenic non-human animals.

The transgenic non-human animals can be, e.g., goats, rabbits, sheep, pigs (including all swine, hogs and related animals), cows, rats and mice, comprising the nucleic acids of the invention. These animals can be used, e.g., as in vivo models to study ammonia lyase, e.g., phenylalanine ammonia lyase, tyrosine ammonia lyase and/or histidine ammonia lyase enzyme activity, or, as models to screen for agents that change the ammonia lyase, e.g., phenylalanine ammonia lyase, tyrosine ammonia lyase and/or histidine ammonia lyase enzyme activity in vivo. The coding sequences for the polypeptides to be expressed in the transgenic non-human animals can be designed to be constitutive, or, under the control of tissue-specific, developmental-specific or inducible transcriptional regulatory factors. Transgenic non-human animals can be designed and generated using any method known in the art; see, e.g., U.S. Pat. Nos. 6,211,428; 6,187,992; 6,156,952; 6,118,044; 6,111,166; 6,107,541; 5,959,171; 5,922,854; 5,892,070; 5,880,327; 5,891,698; 5,639,940; 5,573,933; 5,387,742; 5,087,571, describing making and using transformed cells and eggs and transgenic mice, rats, rabbits, sheep, pigs and cows. See also, e.g., Pollock (1999) J. Immunol. Methods 231:147-157, describing the production of recombinant proteins in the milk of transgenic dairy animals; Baguisi (1999) Nat. Biotechnol. 17:456-461, demonstrating the production of transgenic goats. U.S. Pat. No. 6,211,428, describes making and using transgenic non-human mammals which express in their brains a nucleic acid construct comprising a DNA sequence. U.S. Pat. No. 5,387, 742, describes injecting cloned recombinant or synthetic DNA sequences into fertilized mouse eggs, implanting the injected eggs in pseudo-pregnant females, and growing to term transgenic mice. U.S. Pat. No. 6,187,992, describes making and using a transgenic mouse.

"Knockout animals" can also be used to practice the methods of the invention. For example, in one aspect, the transgenic or modified animals of the invention comprise a "knockout animal," e.g., a "knockout mouse," engineered not to express an endogenous gene, which is replaced with a gene expressing an ammonia lyase, e.g., phenylalanine ammonia lyase, tyrosine ammonia lyase and/or histidine ammonia lyase enzyme of the invention, or, a fusion protein comprising an ammonia lyase, e.g., phenylalanine ammonia lyase, tyrosine ammonia lyase and/or histidine ammonia lyase enzyme of the invention.

Transgenic Plants and Seeds

The invention provides transgenic plants and seeds comprising a nucleic acid, a polypeptide (e.g., an ammonia lyase, e.g., phenylalanine ammonia lyase, tyrosine ammonia lyase and/or histidine ammonia lyase enzyme), an expression cassette or vector or a transfected or transformed cell of the invention. The invention also provides plant products, e.g., oils, seeds, leaves, extracts and the like, comprising a nucleic acid and/or a polypeptide (e.g., an ammonia lyase, e.g., phenylalanine ammonia lyase, tyrosine ammonia lyase and/or histidine ammonia lyase enzyme) of the invention. The transgenic plant can be dicotyledonous (a dicot) or monocotyledonous (a monocot). The invention also provides methods of making and using these transgenic plants and seeds. The transgenic plant or plant cell expressing a polypeptide of the present invention may be constructed in accordance with any method known in the art. See, for example, U.S. Pat. No. 6,309,872.

Nucleic acids and expression constructs of the invention can be introduced into a plant cell by any means. For example, nucleic acids or expression constructs can be introduced into the genome of a desired plant host, or, the nucleic acids or expression constructs can be episomes. Introduction into the genome of a desired plant can be such that the host's ammonia lyase, e.g., phenylalanine ammonia lyase, tyrosine ammonia lyase and/or histidine ammonia lyase enzyme production is regulated by endogenous transcriptional or translational control elements. The invention also provides "knockout plants" where insertion of gene sequence by, e.g., homologous recombination, has disrupted the expression of the endogenous gene. Means to generate "knockout" plants are well-known in the art, see, e.g., Strepp (1998) Proc Natl. Acad. Sci. USA 95:4368-4373; Miao (1995) Plant J 7:359-365. See discussion on transgenic plants, below.

The nucleic acids of the invention can be used to confer desired traits on essentially any plant, e.g., on starch-producing plants, such as potato, wheat, rice, barley, and the like. Nucleic acids of the invention can be used to manipulate metabolic pathways of a plant in order to optimize or alter host's expression of ammonia lyase, e.g., phenylalanine ammonia lyase, tyrosine ammonia lyase and/or histidine ammonia lyase enzyme. The can change ammonia lyase, e.g., phenylalanine ammonia lyase, tyrosine ammonia lyase and/or histidine ammonia lyase enzyme activity in a plant. Alternatively, an ammonia lyase, e.g., phenylalanine ammonia lyase, tyrosine ammonia lyase and/or histidine ammonia lyase enzyme of the invention can be used in production of a transgenic plant to produce a compound not naturally produced by that plant. This can lower production costs or create a novel product.

In one aspect, the first step in production of a transgenic plant involves making an expression construct for expression in a plant cell. These techniques are well known in the art. They can include selecting and cloning a promoter, a coding sequence for facilitating efficient binding of ribosomes to mRNA and selecting the appropriate gene terminator sequences. One exemplary constitutive promoter is CaMV35S, from the cauliflower mosaic virus, which generally results in a high degree of expression in plants. Other promoters are more specific and respond to cues in the plant's internal or external environment. An exemplary light-inducible promoter is the promoter from the cab gene, encoding the major chlorophyll a/b binding protein.

In one aspect, the nucleic acid is modified to achieve greater expression in a plant cell. For example, a sequence of the invention is likely to have a higher percentage of A-T nucleotide pairs compared to that seen in a plant, some of which prefer G-C nucleotide pairs. Therefore, A-T nucleotides in the coding sequence can be substituted with G-C nucleotides without significantly changing the amino acid sequence to enhance production of the gene product in plant cells.

Selectable marker gene can be added to the gene construct in order to identify plant cells or tissues that have successfully integrated the transgene. This may be necessary because achieving incorporation and expression of genes in plant cells is a rare event, occurring in just a few percent of the targeted tissues or cells. Selectable marker genes encode proteins that provide resistance to agents that are normally toxic to plants, such as antibiotics or herbicides. Only plant cells that have integrated the selectable marker gene will survive when grown on a medium containing the appropriate antibiotic or herbicide. As for other inserted genes, marker genes also require promoter and termination sequences for proper function.

hi one aspect, making transgenic plants or seeds comprises incorporating sequences of the invention and, optionally, marker genes into a target expression construct (e.g., a plasmid), along with positioning of the promoter and the terminator sequences. This can involve transferring the modified gene into the plant through a suitable method. For example, a construct may be introduced directly into the genomic DNA of the plant cell using techniques such as electroporation and microinjection of plant cell protoplasts, or the constructs can be introduced directly to plant tissue using ballistic methods, such as DNA particle bombardment. For example, see, e.g., Christou (1997) Plant Mol. Biol. 35:197-203; Pawlowski (1996) Mol. Biotechnol. 6:17-30; Klein (1987) Nature 327: 70-73; Takumi (1997) Genes Genet. Syst. 72:63-69, discussing use of particle bombardment to introduce trans genes into wheat; and Adam (1997) supra, for use of particle bombardment to introduce YACs into plant cells. For example, Rinehart (1997) supra, used particle bombardment to generate transgenic cotton plants. Apparatus for accelerating particles is described U.S. Pat. No. 5,015,580; and, the commercially available BioRad (Biolistics) PDS-2000 particle acceleration instrument; see also, John, U.S. Pat. No. 5,608,148; and Ellis, U.S. Pat. No. 5,681,730, describing particle-mediated transformation of gymnosperms.

In one aspect, protoplasts can be immobilized and injected with a nucleic acids, e.g., an expression construct. Although plant regeneration from protoplasts is not easy with cereals, plant regeneration is possible in legumes using somatic embryogenesis from protoplast derived callus. Organized tissues can be transformed with naked DNA using gene gun technique, where DNA is coated on tungsten microprojectiles, shot 1/100th the size of cells, which carry the DNA deep into cells and organelles. Transformed tissue is then induced to regenerate, usually by somatic embryogenesis. This technique has been successful in several cereal species including maize and rice.

Nucleic acids, e.g., expression constructs, can also be introduced in to plant cells using recombinant viruses. Plant cells can be transformed using viral vectors, such as, e.g., tobacco mosaic virus derived vectors (Rouwendal (1997) Plant Mol. Biol. 33:989-999), see Porta (1996) "Use of viral replicons for the expression of genes in plants," Mol. Biotechnol. 5:209-221.

Alternatively, nucleic acids, e.g., an expression construct, can be combined with suitable T-DNA flanking regions and introduced into a conventional *Agrobacterium tumefaciens* host vector. The virulence functions of the *Agrobacterium tumefaciens* host will direct the insertion of the construct and adjacent marker into the plant cell DNA when the cell is infected by the bacteria. *Agrobacterium tumefaciens*-m.Qdi-aead transformation techniques, including disarming and use of binary vectors, are well described in the scientific literature. See, e.g., Horsch (1984) Science 233:496-498; Fraley (1983) *Proc. Natl. Acad. Sd. USA* 80:4803 (1983); *Gene Transfer to Plants*, Potrykus, ed. (Springer-Verlag, Berlin 1995). The DNA in an *A. tumefaciens* cell is contained in the bacterial chromosome as well as in another structure known as a Ti (tumor-inducing) plasmid. The Ti plasmid contains a stretch of DNA termed T-DNA (~20 kb long) that is transferred to the plant cell in the infection process and a series of vir (virulence) genes that direct the infection process. *A. tumefaciens* can only infect a plant through wounds: when a plant root or stem is wounded it gives off certain chemical signals, in response to which, the vir genes of *A. tumefaciens* become activated and direct a series of events necessary for the transfer of the T-DNA from the Ti plasmid to the plant's chromosome. The T-DNA then enters the plant cell through the wound. One speculation is that the T-DNA waits until the plant DNA is being replicated or transcribed, then inserts itself into the exposed plant DNA. In order to use *A. tumefaciens* as a transgene vector, the tumor-inducing section of T-DNA have to be removed, while retaining the T-DNA border regions and the vir genes. The transgene is then inserted between the T-DNA border regions, where it is transferred to the plant cell and becomes integrated into the plant's chromosomes.

The invention provides for the transformation of monocotyledonous plants using the nucleic acids of the invention, including important cereals, see Hiei (1997) Plant Mol. Biol. 35:205-218. See also, e.g., Horsch, Science (1984) 233:496; Fraley (1983) Proc. Natl. Acad. Sci. USA 80:4803; Thykjaer (1997) supra; Park (1996) Plant Mol. Biol. 32:1 135-1 148, discussing T-DNA integration into genomic DNA. See also D'Halluin, U.S. Pat. No. 5,712,135, describing a process for the stable integration of a DNA comprising a gene that is functional in a cell of a cereal, or other monocotyledonous plant.

In one aspect, the third step can involve selection and regeneration of whole plants capable of transmitting the incorporated target gene to the next generation. Such regeneration techniques rely on manipulation of certain phytohormones in a tissue culture growth medium, typically relying on a biocide and/or herbicide marker that has been introduced together with the desired nucleotide sequences. Plant regeneration from cultured protoplasts is described in Evans et al., *Protoplasts Isolation and Culture, Handbook of Plant Cell Culture*, pp. 124-176, MacMillilan Publishing Company, New York, 1983; and Binding, *Regeneration of Plants, Plant Protoplasts*, pp. 21-73, CRC Press, Boca Raton, 1985. Regeneration can also be obtained from plant callus, explants, organs, or parts thereof. Such regeneration techniques are described generally in Klee (1987) Ann. Rev. of Plant Phys. 38:467-486. To obtain whole plants from transgenic tissues such as immature embryos, they can be grown under controlled environmental conditions in a series of media containing nutrients and hormones, a process known as tissue culture. Once whole plants are generated and produce seed, evaluation of the progeny begins.

After the expression cassette is stably incorporated in transgenic plants, it can be introduced into other plants by sexual crossing. Any of a number of standard breeding techniques can be used, depending upon the species to be crossed. Since transgenic expression of the nucleic acids of the invention leads to phenotypic changes, plants comprising the recombinant nucleic acids of the invention can be sexually crossed with a second plant to obtain a final product. Thus, the seed of the invention can be derived from a cross between two transgenic plants of the invention, or a cross between a plant of the invention and another plant. The desired effects (e.g., expression of the polypeptides of the invention to produce a plant in which flowering behavior is altered) can be enhanced when both parental plants express the polypeptides (e.g., an ammonia lyase, e.g., phenylalanine ammonia lyase, tyrosine ammonia lyase and/or histidine ammonia lyase enzyme) of the invention. The desired effects can be passed to future plant generations by standard propagation means.

The nucleic acids and polypeptides of the invention are expressed in or inserted in any plant or seed. Transgenic plants of the invention can be dicotyledonous or monocotyledonous. Examples of monocot transgenic plants of the invention are grasses, such as meadow grass (blue grass, Pod), forage grass such as festuca, lolium, temperate grass, such as *Agrostis*, and cereals, e.g., wheat, oats, rye, barley, rice, sorghum, and maize (corn). Examples of dicot transgenic plants of the invention are tobacco, legumes, such as lupins, potato, sugar beet, pea, bean and soybean, and cruciferous plants (family Brassicaceae), such as cauliflower, rape seed, and the closely related model organism *Arabidopsis thaliana*. Thus, the transgenic plants and seeds of the invention include a broad range of plants, including, but not limited to, species from the genera *Anacardium, Arachis, Asparagus, Atropa, Avena, Brassica, Citrus, Citrullus, Capsicum, Carthamus, Cocos, Coffea, Cucumis, Cucurbita, Daucus, Elaeis, Fragaria, Glycine, Gossypium, Helianthus, Heterocallis, Hordeum, Hyoscyamus, Lactuca, Linum, Lolium, Lupinus, Lycopersicon, Malus, Manihot, Majorana, Medicago, Nicotiana, Olea, Oryza, Panieum, Pannisetum, Persea, Phaseolus, Pistachia, Pisum, Pyrus, Prunus, Raphanus, Ricinus, Secale, Senecio, Sinapis, Solarium, Sorghum, Theobromus, Trigonella, Triticum, Vicia, Vitis, Vigna,* and *Zea.*

In alternative embodiments, the nucleic acids of the invention are expressed in plants which contain fiber cells, including, e.g., cotton, silk cotton tree (Kapok, Ceiba pentandra), desert willow, creosote bush, winterfat, balsa, ramie, kenaf, hemp, roselle, jute, sisal abaca and f ax. In alternative embodiments, the transgenic plants of the invention can be members of the genus *Gossypium*, including members of any *Gossypium* species, such as *G. arboreum; G. herbaceum, G. barbadense,* and *G. hirsutum.*

The invention also provides for transgenic plants to be used for producing large amounts of the polypeptides (e.g., an ammonia lyase, e.g., phenylalanine ammonia lyase, tyrosine ammonia lyase and/or histidine ammonia lyase enzyme or antibody) of the invention. For example, see Palmgren (1997) Trends Genet. 13:348; Chong (1997) Transgenic Res. 6:289-296 (producing human milk protein beta-casein in transgenic potato plants using an auxin-inducible, bidirectional mannopine synthase (masr,2') promoter with *Agrobacterium tumefaciens-medieaQd* leaf disc transformation methods).

Using known procedures, one of skill can screen for plants of the invention by detecting the increase or decrease of transgene mRNA or protein in transgenic plants. Means for detecting and quantitation of mRNAs or proteins are well known in the art.

Polypeptides and Peptides

In one aspect, the invention provides isolated, synthetic or recombinant polypeptides having a sequence identity (e.g., at least about 50%, 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more, or complete (100%) sequence identity, or homology) to an exemplary sequence of the invention, including all even-numbered SEQ ID NO: s between SEQ ID NO:2 and SEQ ID NO:252). The percent sequence identity can be over the full length of the polypeptide, or, the identity can be over a region of at least about 50, 60, 70, 80, 90, 100, 150, 200, 250, 300, 350, 400, 450, 500, 550, 600, 650, 700 or more residues.

Polypeptides of the invention can also be shorter than the full length of exemplary polypeptides. In alternative aspects, the invention provides polypeptides (peptides, fragments) ranging in size between about 5 and the full length of a polypeptide, e.g., an enzyme, such as an ammonia lyase, e.g., phenylalanine ammonia lyase, tyrosine ammonia lyase and/ or histidine ammonia lyase enzyme; exemplary sizes being of about 5, 10, 15, 20, 25, 30, 35, 40, 45, 50, 55, 60, 65, 70, 75, 80, 85, 90, 100, 125, 150, 175, 200, 250, 300, 350, 400, 450, 500, 550, 600, 650, 700, or more residues, e.g., contiguous residues of an exemplary ammonia lyase, e.g., phenylalanine ammonia lyase, tyrosine ammonia lyase and/or histidine ammonia lyase enzyme of the invention. Peptides of the invention (e.g., a subsequence of an exemplary polypeptide of the invention) can be useful as, e.g., labeling probes, antigens, toleragens, motifs, ammonia lyase, e.g., phenylalanine ammonia lyase, tyrosine ammonia lyase and/or histidine ammonia lyase enzyme active sites (e.g., "catalytic domains"), signal sequences and/or prepro domains. By a "polypeptide having a lyase activity" is meant a polypeptide that either by itself, or in association with one or more additional polypeptides (having the same or a different sequence), is a protein with the enzymatic activity of a lyase.

In one aspect, "fragments" as used herein are a portion of a naturally occurring protein which can exist in at least two different conformations. Fragments can have the same or substantially the same amino acid sequence as the naturally occurring protein. Fragments which have different three dimensional structures as the naturally occurring protein are also included. An example of this, is a "pro-form" molecule, such as a low activity proprotein that can be modified by cleavage to produce a mature enzyme with significantly higher activity.

"Amino acid" or "amino acid sequence" as used herein refer to an oligopeptide, peptide, polypeptide, or protein sequence, or to a fragment, portion, or subunit of any of these and to naturally occurring or synthetic molecules. "Amino acid" or "amino acid sequence" include an oligopeptide, peptide, polypeptide, or protein sequence, or to a fragment, portion, or subunit of any of these, and to naturally occurring or synthetic molecules. The term "polypeptide" as used herein, refers to amino acids joined to each other by peptide bonds or modified peptide bonds, i.e., peptide isosteres and may contain modified amino acids other than the 20 gene-encoded amino acids. The polypeptides may be modified by either natural processes, such as post-translational processing, or by chemical modification techniques which are well known in the art. Modifications can occur anywhere in the polypeptide, including the peptide backbone, the amino acid side-chains and the amino or carboxyl termini. It will be appreciated that the same type of modification may be present in the same or varying degrees at several sites in a given polypeptide. Also a given polypeptide may have many types of modifications. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of a phosphatidylinositol, cross-linking cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristolyation, oxidation, pegylation, glucan hydrolase processing, phosphorylation, prenylation, racemization, selenoylation, sulfation and transfer-RNA mediated addition of amino acids to protein such as arginylation. {See Creighton, T. E., Proteins—Structure and Molecular Properties 2nd Ed., W.H. Freeman and Company, New York (1993); *Posttranslational Covalent Modification of Proteins*, B. C. Johnson, Ed., Academic Press, New York, pp. 1-12 (1983)). The peptides and polypeptides of the invention also include all "mimetic" and "peptidomimetic" forms, as described in further detail, below.

A s used herein, the term "isolated" means that the material is removed from its original environment {e.g., the natural environment if it is naturally occurring). For example, a naturally-occurring polynucleotide or polypeptide present in a living animal is not isolated, but the same polynucleotide or polypeptide, separated from some or all of the coexisting materials in the natural system, is isolated. Such polynucleotides could be part of a vector and/or such polynucleotides or polypeptides could be part of a composition and still be isolated in that such vector or composition is not part of its natural environment. A s used herein, the term "purified" does not require absolute purity; rather, it is intended as a relative definition. Individual nucleic acids obtained from a library have been conventionally purified to electrophoretic homogeneity. The sequences obtained from these clones could not be obtained directly either from the library or from total human DNA. The purified nucleic acids of the invention have been purified from the remainder of the genomic DNA in the organism by at least $10^4$-$10^6$ fold. However, the term "purified" also includes nucleic acids which have been purified from the remainder of the genomic DNA or from other sequences in a library or other environment by at least one order of magnitude, typically two or three orders and more typically four or five orders of magnitude.

"Recombinant" polypeptides or proteins refer to polypeptides or proteins produced by recombinant DNA techniques; i.e., produced from cells transformed by an exogenous DNA construct encoding the desired polypeptide or protein. "Synthetic" polypeptides or protein are those prepared by chemical synthesis. Solid-phase chemical peptide synthesis methods can also be used to synthesize the polypeptide or fragments of the invention. Such method have been known in the art since the early 1960's (Merrifield, R. B., *J. Am. Chem. Soc*, 0.85:2149-2154, 1963) (See also Stewart, J. M. and Young, J. D., Solid Phase Peptide Synthesis, 2nd Ed., Pierce Chemical Co., Rockford, 111., pp. 11-12)) and have recently been employed in commercially available laboratory peptide design and synthesis kits (Cambridge Research Biochemicals). Such commercially available laboratory kits have generally utilized the teachings of H. M. Geysen et al, *Proc. Natl.*

*Acad. ScL, USA,* 81:3998 (1984) and provide for synthesizing peptides upon the tips of a multitude of "rods" or "pins" all of which are connected to a single plate.

In alternative aspects, the terms "ammonia lyase, e.g., phenylalanine ammonia lyase, tyrosine ammonia lyase and/or histidine ammonia lyase" encompass any polypeptide or enzymes capable of catalyzing the deamination of phenylalanine or tyrosine to trans-cinnamic acid and ammonia and/or catalyzing the abstraction of ammonia from histidine to form urocanoic acid, including, e.g., the exemplary polypeptides and polynucleotides of the invention (e.g., SEQ ID NO: s 1-252).

In alternative aspects, polypeptides of the invention having ammonia lyase activity, e.g., phenylalanine ammonia lyase, tyrosine ammonia lyase and/or histidine ammonia lyase activity are members of a genus of polypeptides sharing specific structural elements, e.g., amino acid residues that correlate with ammonia lyase activity, e.g., phenylalanine ammonia lyase, tyrosine ammonia lyase and/or histidine ammonia lyase activity. These shared structural elements can be used for the routine generation of ammonia lyase, e.g., phenylalanine ammonia lyase, tyrosine ammonia lyase and/or histidine ammonia lyase variants. These shared structural elements of ammonia lyase, e.g., phenylalanine ammonia lyase, tyrosine ammonia lyase and/or histidine ammonia lyase enzymes of the invention can be used as guidance for the routine generation of ammonia lyase, e.g., phenylalanine ammonia lyase, tyrosine ammonia lyase and/or histidine ammonia lyase enzymes variants within the scope of the genus of polypeptides of the invention.

Polypeptides of the invention can be used in the synthesis or manufacture of amino acid derivatives, including β-amino acid derivatives, e.g. phenylalanine, histidine or tyrosine derivatives, wherein a β-amino acid, e.g. phenylalanine, histidine or tyrosine, is altered by substituting a halogen-, methyl-, ethyl-, hydroxy-, hydroxymethyl-, nitro-, or amino-comprising group in any or all of the 2, 3, 4, and 5 positions in the benzyl ring of the amino acid. For example, polypeptides of the invention can be used in the synthesis or manufacture of ortho, meta and para isomers of phenylalanine, histidine and/or tyrosine, e.g., ortho-, meta- or para-bromo phenylalanine; ortho-, meta- or para-fluoro phenylalanine; ortho-, meta- or para-iodo phenylalanine; ortho-, meta- or para-chloro phenylalanine; ortho-, meta- or para-methyl phenylalanine; ortho-, meta- or para-hydroxyl phenylalanine; ortho-, meta- or para-hydroxymethyl phenylalanine; ortho-, meta- or para-ethyl phenylalanine ortho-, meta- or para-nitro phenylalanine; ortho-, meta- or para-amino phenylalanine; ortho-, meta- or para-bromo histidine; ortho-, meta- or para-fluoro histidine; ortho-, meta- or para-iodo histidine; ortho-, meta- or para-chloro histidine; ortho-, meta- or para-methyl histidine; ortho-, meta- or para-hydroxyl histidine; ortho-, meta- or para-hydroxymethyl histidine; ortho-, meta- or para-ethyl histidine ortho-, meta- or para-nitro histidine; ortho-, meta- or para-amino histidine; ortho-, meta- or para-bromo tyrosine; ortho-, meta- or para-fluoro tyrosine; ortho-, meta- or para-iodo tyrosine; ortho-, meta- or para-chloro tyrosine; ortho-, meta- or para-methyl tyrosine; ortho-, meta- or para-hydroxyl tyrosine; ortho-, meta- or para-hydroxymethyl tyrosine; ortho-, meta- or para-ethyl tyrosine ortho-, meta- or para-nitro tyrosine; ortho-, meta- or para-amino tyrosine, all in both L and D enantiomers, such as L- and D-β-amino acids (e.g., L-phenylalanine and D-phenylalanine, L- and D-histidine, L- and D-tyrosine), as well as derivatives thereof. Polypeptides of the invention can also be used in the synthesis or manufacture of urocanoic acid and urocanoic acid derivatives, from histidine and histidine derivatives.

Additionally, the crystal (three-dimensional) structure of ammonia lyases have been analyzed, e.g., see Calabrese, et al (2004) "Crystal structure of phenylalanine ammonia lyase: multiple helix dipoles implicated in catalysis", Biochemistry, 43(36):1 1403-16; Levy, et al (2002) "Insights into enzyme evolution revealed by the structure of methylaspartate ammonia lyase", Structure (Camb), 10(1):105-13; Baedeker, et al (2002) "Autocatalytic peptide cyclization during chain folding of histidine ammonia-lyase", Structure (Camb), 10(1):61-7; Schwede, et al (1999) "Crystal structure of histidine ammonia-lyase revealing a novel polypeptide modification as the catalytic electrophile", Biochemistry, 27; 38(17):5355-61; Shi, et al (1997) "The structure of L-aspartate ammonialyase from *Escherichia coli*", Biochemistry, 36(30):9136-44., illustrating specific structural elements as guidance for the routine generation of ammonia lyase variants.

Polypeptides and peptides of the invention can be isolated from natural sources, be synthetic, or be recombinantly generated polypeptides. Peptides and proteins can be recombinantly expressed in vitro or in vivo. The peptides and polypeptides of the invention can be made and isolated using any method known in the art. Polypeptide and peptides of the invention can also be synthesized, whole or in part, using chemical methods well known in the art. See e.g., Caruthers (1980) Nucleic Acids Res. Symp. Ser. 215-223; Horn (1980) Nucleic Acids Res. Symp. Ser. 225-232; Banga, A. K., Therapeutic Peptides and Proteins, Formulation, Processing and Delivery Systems (1995) Technomic Publishing Co., Lancaster, Pa. For example, peptide synthesis can be performed using various solid-phase techniques (see e.g., Roberge (1995) Science 269:202; Merrifield (1997) Methods Enzymol. 289:3-13) and automated synthesis maybe achieved, e.g., using the ABI 431A Peptide Synthesizer (Perkin Elmer) in accordance with the instructions provided by the manufacturer.

The peptides and polypeptides of the invention can also be glycosylated. The glycosylation can be added post-translationally either chemically or by cellular biosynthetic mechanisms, wherein the later incorporates the use of known glycosylation motifs, which can be native to the sequence or can be added as a peptide or added in the nucleic acid coding sequence. The glycosylation can be O-linked or N-linked.

The peptides and polypeptides of the invention, as defined above, include all "mimetic" and "peptidomimetic" forms. The terms "mimetic" and "peptidomimetic" refer to a synthetic chemical compound which has substantially the same structural and/or functional characteristics of the polypeptides of the invention. The mimetic can be either entirely composed of synthetic, non-natural analogues of amino acids, or, is a chimeric molecule of partly natural peptide amino acids and partly non-natural analogs of amino acids. The mimetic can also incorporate any amount of natural amino acid conservative substitutions as long as such substitutions also do not substantially alter the mimetic's structure and/or activity. As with polypeptides of the invention which are conservative variants or members of a genus of polypeptides of the invention (e.g., having about 50% or more sequence identity to an exemplary sequence of the invention), routine experimentation will determine whether a mimetic is within the scope of the invention, i.e., that its structure and/or function is not substantially altered. Thus, in one aspect, a mimetic composition is within the scope of the invention if it has an ammonia lyase, e.g., phenylalanine ammonia lyase, tyrosine ammonia lyase and/or histidine ammonia lyase enzymes activity.

Polypeptide mimetic compositions of the invention can contain any combination of non-natural structural components. In alternative aspect, mimetic compositions of the invention include one or all of the following three structural groups: a) residue linkage groups other than the natural amide bond ("peptide bond") linkages; b) non-natural residues in place of naturally occurring amino acid residues; or c) residues which induce secondary structural mimicry, i.e., to induce or stabilize a secondary structure, e.g., a beta turn, gamma turn, beta sheet, alpha helix conformation, and the like. For example, a polypeptide of the invention can be characterized as a mimetic when all or some of its residues are joined by chemical means other than natural peptide bonds. Individual peptidomimetic residues can be joined by peptide bonds, other chemical bonds or coupling means, such as, e.g., glutaraldehyde, N-hydroxysuccinimide esters, bifunctional maleimides, N,N'-dicyclohexylcarbodiimide (DCC) or N,N'-diisopropylcarbodiimide (DIC). Linking groups that can be an alternative to the traditional amide bond ("peptide bond") linkages include, e.g., ketomethylene (e.g., —C(=O)—CH$_2$— for —C(=O)—NH—), aminomethylene (CH$_2$—NH), ethylene, olefin (CH=CH), ether (CH$_2$—O), thioether (CH$_2$—S), tetrazole (CN$_4$—), thiazole, retroamide, thioamide, or ester (see, e.g., Spatola (1983) in Chemistry and Biochemistry of Amino Acids, Peptides and Proteins, Vol. 7, pp 267-357, "Peptide Backbone Modifications," Marcell Dekker, NY).

A polypeptide of the invention can also be characterized as a mimetic by containing all or some non-natural residues in place of naturally occurring amino acid residues. Non-natural residues are well described in the scientific and patent literature; a few exemplary non-natural compositions useful as mimetics of natural amino acid residues and guidelines are described below. Mimetics of aromatic amino acids can be generated by replacing by, e.g., D- or L-naphylalanine; D- or L-phenylglycine; D- or L-2 thieneylalanine; D- or L-I, -2,3-, or 4-pyreneylalanine; D- or L-3 thieneylalanine; D- or L-(2-pyridinyl)-alanine; D- or L-(3-pyridinyl)-alanine; D- or L-(2-pyrazinyl)-alanine; D- or L-(4-isopropyl)-phenylglycine; D-(trifluoromethyl)-phenylglycine; D-(trifluoromethyl)-phenylalanine; D-p-fluoro-phenylalanine; D- or L-p-biphenylphenylalanine; D- or L-p-methoxy-biphenylphenylalanine; D- or L-2-indole(alkyl)alanines; and, D- or L-alkylainines, where alkyl can be substituted or unsubstituted methyl, ethyl, propyl, hexyl, butyl, pentyl, isopropyl, iso-butyl, sec-isotyl, iso-pentyl, or a non-acidic amino acids. Aromatic rings of a non-natural amino acid include, e.g., thiazolyl, thiophenyl, pyrazolyl, benzimidazolyl, naphthyl, furanyl, pyrrolyl, and pyridyl aromatic rings.

Mimetics of acidic amino acids can be generated by substitution by, e.g., non-carboxylate amino acids while maintaining a negative charge; (phosphono)alanine; sulfated threonine. Carboxyl side groups (e.g., aspartyl or glutamyl) can also be selectively modified by reaction with carbodiimides (R'—N—C—N—R') such as, e.g., 1-cyclohexyl-3(2-morpholinyl-(4-ethyl) carbodiimide or 1-ethyl-3(4-azonia-4, 4-dimetholpentyl) carbodiimide. Aspartyl or glutamyl can also be converted to asparaginyl and glutaminyl residues by reaction with ammonium ions. Mimetics of basic amino acids can be generated by substitution with, e.g., (in addition to lysine and arginine) the amino acids ornithine, citrulline, or (guanidino)-acetic acid, or (guanidino)alkyl-acetic acid, where alkyl is defined above. Nitrile derivative (e.g., containing the CN-moiety in place of COOH) can be substituted for asparagine or glutamine. Asparaginyl and glutaminyl residues can be deaminated to the corresponding aspartyl or glutamyl residues. Arginine residue mimetics can be generated by reacting arginyl with, e.g., one or more conventional reagents, including, e.g., phenylglyoxal, 2,3-butanedione, 1,2-cyclo-hexanedione, or ninhydrin, in one aspect under alkaline conditions. Tyrosine residue mimetics can be generated by reacting tyrosyl with, e.g., aromatic diazonium compounds or tetranitromethane. N-acetylimidizol and tetranitromethane can be used to form O-acetyl tyrosyl species and 3-nitro derivatives, respectively. Cysteine residue mimetics can be generated by reacting cysteinyl residues with, e.g., alpha-haloacetates such as 2-chloroacetic acid or chloroacetamide and corresponding amines; to give carboxymethyl or carboxyamidomethyl derivatives. Cysteine residue mimetics can also be generated by reacting cysteinyl residues with, e.g., bromo-trifluoroacetone, alpha-bromo-beta-(5-imidozoyl) propionic acid; chloroacetyl phosphate, N-alkylmaleimides, 3-nitro-2-pyridyl disulfide; methyl 2-pyridyl disulfide; p-chloromercuribenzoate; 2-chloromercuri-4 nitrophenol; or, chloro-7-nitrobenzo-oxa-1,3-diazole. Lysine mimetics can be generated (and amino terminal residues can be altered) by reacting lysinyl with, e.g., succinic or other carboxylic acid anhydrides. Lysine and other alpha-amino-containing residue mimetics can also be generated by reaction with imidoesters, such as methyl picolinimidate, pyridoxal phosphate, pyridoxal, chloroborohydride, trinitro-benzene-sulfonic acid, O-methylisourea, 2,4, pentanedione, and transamidase-catalyzed reactions with glyoxylate. Mimetics of methionine can be generated by reaction with, e.g., methionine sulfoxide. Mimetics of proline include, e.g., pipecolic acid, thiazolidine carboxylic acid, 3- or 4-hydroxy proline, dehydroproline, 3- or 4-methylproline, or 3,3,-dimethylproline. Histidine residue mimetics can be generated by reacting histidyl with, e.g., diethylprocarbonate or para-bromophenacyl bromide. Other mimetics include, e.g., those generated by hydroxylation of proline and lysine; phosphorylation of the hydroxyl groups of seryl or threonyl residues; methylation of the alpha-amino groups of lysine, arginine and histidine; acetylation of the N-terminal amine; methylation of main chain amide residues or substitution with N-methyl amino acids; or amidation of C-terminal carboxyl groups.

A residue, e.g., an amino acid, of a polypeptide of the invention can also be replaced by an amino acid (or peptidomimetic residue) of the opposite chirality. Thus, any amino acid naturally occurring in the L-configuration (which can also be referred to as the R or S, depending upon the structure of the chemical entity) can be replaced with the amino acid of the same chemical structural type or a peptidomimetic, but of the opposite chirality, referred to as the D-amino acid, but also can be referred to as the R— or S— form.

The invention also provides methods for modifying the polypeptides of the invention by either natural processes, such as post-translational processing (e.g., phosphorylation, acylation, etc), or by chemical modification techniques, and the resulting modified polypeptides. Modifications can occur anywhere in the polypeptide, including the peptide backbone, the amino acid side-chains and the amino or carboxyl termini. It will be appreciated that the same type of modification may be present in the same or varying degrees at several sites in a given polypeptide. Also a given polypeptide may have many types of modifications. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of a phosphatidylinositol, cross-linking cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristolyation, oxidation, pegylation, proteolytic processing, phosphorylation, prenylation, racemization, selenoylation, sulfation, and transfer-RNA mediated addition of amino acids to protein such as arginylation. See, e.g., Creighton, T. E., Proteins—Structure and Molecular Properties 2nd Ed., W.H. Freeman and Company, New York (1993); Posttranslational Covalent Modification of Proteins, B. C. Johnson, Ed., Academic Press, New York, pp. 1-12 (1983).

Solid-phase chemical peptide synthesis methods can also be used to synthesize the polypeptide or fragments of the invention. Such method have been known in the art since the early 1960's (Merrifield, R. B., J. Am. Chem. Soc, 85:2149-2154, 1963) (See also Stewart, J. M. and Young, J. D., Solid Phase Peptide Synthesis, 2nd Ed., Pierce Chemical Co., Rockford, 111., pp. 11-12)) and have recently been employed in commercially available laboratory peptide design and synthesis kits (Cambridge Research Biochemicals). Such commercially available laboratory kits have generally utilized the teachings of H. M. Geysen et al, Proc. Natl. Acad. Sci., USA, 81:3998 (1984) and provide for synthesizing peptides upon the tips of a multitude of "rods" or "pins" all of which are connected to a single plate. When such a system is utilized, a plate of rods or pins is inverted and inserted into a second plate of corresponding wells or reservoirs, which contain solutions for attaching or anchoring an appropriate amino acid to the pin's or rod's tips. By repeating such a process step, i.e., inverting and inserting the rod's and pin's tips into appropriate solutions, amino acids are built into desired peptides. In addition, a number of available FMOC peptide synthesis systems are available. For example, assembly of a polypeptide or fragment can be carried out on a solid support using an Applied Biosystems, Inc. Model 431 A™ automated peptide synthesizer. Such equipment provides ready access to the peptides of the invention, either by direct synthesis or by synthesis of a series of fragments that can be coupled using other known techniques.

The polypeptides of the invention include ammonia lyase, e.g., phenylalanine ammonia lyase, tyrosine ammonia lyase and/or histidine ammonia lyase enzymes in an active or inactive form. For example, the polypeptides of the invention include proproteins before "maturation" or processing of prepro sequences, e.g., by a proprotein-processing enzyme, such as a proprotein convertase to generate an "active" mature protein. The polypeptides of the invention include ammonia lyase, e.g., phenylalanine ammonia lyase, tyrosine ammonia lyase and/or histidine ammonia lyase enzymes inactive for other reasons, e.g., before "activation" by a post-translational processing event, e.g., an endo- or exo-peptidase or proteinase action, a phosphorylation event, an amidation, a glycosylation or a sulfation, a dimerization event, and the like. The polypeptides of the invention include all active forms, including active subsequences, e.g., catalytic domains or active sites, of the enzyme.

The invention includes immobilized ammonia lyase, e.g., phenylalanine ammonia lyase, tyrosine ammonia lyase and/or histidine ammonia lyase enzymes, anti-ammonia lyase, e.g., anti-phenylalanine ammonia lyase, anti-tyrosine ammonia lyase and/or anti-histidine ammonia lyase enzyme antibodies and fragments thereof. The invention provides methods for inhibiting ammonia lyase, e.g., phenylalanine ammonia lyase, tyrosine ammonia lyase and/or histidine ammonia lyase enzyme activity, e.g., using dominant negative mutants or anti-ammonia lyase, e.g., anti-phenylalanine ammonia lyase, anti-tyrosine ammonia lyase and/or anti-histidine ammonia lyase enzyme antibodies of the invention. The invention includes heterocomplexes, e.g., fusion proteins, heterodimers, etc., comprising the ammonia lyase, e.g., phenylalanine ammonia lyase, tyrosine ammonia lyase and/or histidine ammonia lyase enzymes of the invention.

Polypeptides of the invention can have an ammonia lyase, e.g., phenylalanine ammonia lyase, tyrosine ammonia lyase and/or histidine ammonia lyase enzyme activity under various conditions, e.g., extremes in pH and/or temperature, oxidizing agents, and the like. The invention provides methods leading to alternative ammonia lyase, e.g., phenylalanine ammonia lyase, tyrosine ammonia lyase and/or histidine ammonia lyase enzyme preparations with different catalytic efficiencies and stabilities, e.g., towards temperature, oxidizing agents and changing wash conditions. In one aspect, ammonia lyase, e.g., phenylalanine ammonia lyase, tyrosine ammonia lyase and/or histidine ammonia lyase enzyme variants can be produced using techniques of site-directed mutagenesis and/or random mutagenesis. In one aspect, directed evolution can be used to produce a great variety of ammonia lyase, e.g., phenylalanine ammonia lyase, tyrosine ammonia lyase and/or histidine ammonia lyase enzyme variants with alternative specificities and stability.

The proteins of the invention are also useful as research reagents to identify ammonia lyase, e.g., phenylalanine ammonia lyase, tyrosine ammonia lyase and/or histidine ammonia lyase enzyme modulators, e.g., activators or inhibitors of ammonia lyase, e.g., phenylalanine ammonia lyase, tyrosine ammonia lyase and/or histidine ammonia lyase enzyme activity. Briefly, test samples (compounds, broths, extracts, and the like) are added to ammonia lyase, e.g., phenylalanine ammonia lyase, tyrosine ammonia lyase and/or histidine ammonia lyase enzyme assays to determine their ability to inhibit substrate cleavage. Inhibitors identified in this way can be used in industry and research to reduce or prevent undesired proteolysis. As with ammonia lyase, e.g., phenylalanine ammonia lyase, tyrosine ammonia lyase and/or histidine ammonia lyase enzymes, inhibitors can be combined to increase the spectrum of activity.

The enzymes of the invention are also useful as research reagents to digest proteins or in protein sequencing. For example, the ammonia lyase, e.g., phenylalanine ammonia lyase, tyrosine ammonia lyase and/or histidine ammonia lyase enzymes may be used to break polypeptides into smaller fragments for sequencing using, e.g. an automated sequencer.

The invention also provides methods of discovering new ammonia lyase, e.g., phenylalanine ammonia lyase, tyrosine ammonia lyase and/or histidine ammonia lyase enzymes using the nucleic acids, polypeptides and antibodies of the invention. In one aspect, phagemid libraries are screened for expression-based discovery of ammonia lyase, e.g., phenylalanine ammonia lyase, tyrosine ammonia lyase and/or histidine ammonia lyase enzymes. In another aspect, lambda phage libraries are screened for expression-based discovery of ammonia lyase, e.g., phenylalanine ammonia lyase, tyrosine ammonia lyase and/or histidine ammonia lyase enzymes. Screening of the phage or phagemid libraries can allow the detection of toxic clones; improved access to substrate; reduced need for engineering a host, by-passing the potential for any bias resulting from mass excision of the library; and, faster growth at low clone densities. Screening of phage or phagemid libraries can be in liquid phase or in solid phase. In one aspect, the invention provides screening in liquid phase. This gives a greater flexibility in assay conditions; additional substrate flexibility; higher sensitivity for weak clones; and ease of automation over solid phase screening.

The invention provides screening methods using the proteins and nucleic acids of the invention and robotic automation to enable the execution of many thousands of biocatalytic reactions and screening assays in a short period of time, e.g., per day, as well as ensuring a high level of accuracy and reproducibility (see discussion of arrays, below). As a result, a library of derivative compounds can be produced in a matter of weeks. For further teachings on modification of molecules, including small molecules, see PCT/US94/09174.

In one aspect, polypeptides or fragments of the invention may be obtained through biochemical enrichment or purification procedures. The sequence of potentially homologous polypeptides or fragments may be determined by ammonia lyase, e.g., phenylalanine ammonia lyase, tyrosine ammonia lyase and/or histidine ammonia lyase enzyme assays (see, e.g., Examples 1, 2 and 3, below), gel electrophoresis and/or microsequencing. The sequence of the prospective polypeptide or fragment of the invention can be compared to an exemplary polypeptide of the invention, or a fragment, e.g., comprising at least about 5, 10, 15, 20, 25, 30, 35, 40, 50, 75, 100, or 150 or more consecutive amino acids thereof using any of the programs described above.

Another aspect of the invention is an assay for identifying fragments or variants of the invention, which retain the enzymatic function of the polypeptides of the invention. For example the fragments or variants of said polypeptides, may be used to catalyze biochemical reactions, which indicate that the fragment or variant retains the enzymatic activity of a polypeptide of the invention.

An exemplary assay for determining if fragments of variants retain the enzymatic activity of the polypeptides of the invention includes the steps of: contacting the polypeptide fragment or variant with a substrate molecule under conditions which allow the polypeptide fragment or variant to function and detecting either a decrease in the level of substrate or an increase in the level of the specific reaction product of the reaction between the polypeptide and substrate.

The present invention exploits the unique catalytic properties of enzymes. Whereas the use of biocatalysts (i.e., purified or crude enzymes, non-living or living cells) in chemical transformations normally requires the identification of a particular biocatalyst that reacts with a specific starting compound, the present invention uses selected biocatalysts and reaction conditions that are specific for functional groups that are present in many starting compounds, such as small molecules. Each biocatalyst is specific for one functional group, or several related functional groups and can react with many starting compounds containing this functional group.

The biocatalytic reactions produce a population of derivatives from a single starting compound. These derivatives can be subjected to another round of biocatalytic reactions to produce a second population of derivative compounds. Thousands of variations of the original small molecule or compound can be produced with each iteration of biocatalytic derivatization.

Enzymes react at specific sites of a starting compound without affecting the rest of the molecule, a process which is very difficult to achieve using traditional chemical methods. This high degree of biocatalytic specificity provides the means to identify a single active compound within the library. The library is characterized by the series of biocatalytic reactions used to produce it, a so-called "biosynthetic history". Screening the library for biological activities and tracing the biosynthetic history identifies the specific reaction sequence producing the active compound. The reaction sequence is repeated and the structure of the synthesized compound determined. This mode of identification, unlike other synthesis and screening approaches, does not require immobilization technologies and compounds can be synthesized and tested free in solution using virtually any type of screening assay. It is important to note, that the high degree of specificity of enzyme reactions on functional groups allows for the "tracking" of specific enzymatic reactions that make up the biocatalytically produced library.

Many of the procedural steps are performed using robotic automation enabling the execution of many thousands of biocatalytic reactions and screening assays per day as well as ensuring a high level of accuracy and reproducibility. As a result, a library of derivative compounds can be produced in a matter of weeks, which would take years to produce using current chemical methods.

In a particular aspect, the invention provides a method for modifying small molecules, comprising contacting a polypeptide encoded by a polynucleotide described herein or enzymatically active fragments thereof with a small molecule to produce a modified small molecule. A library of modified small molecules is tested to determine if a modified small molecule is present within the library, which exhibits a desired activity. A specific biocatalytic reaction which produces the modified small molecule of desired activity is identified by systematically eliminating each of the biocatalytic reactions used to produce a portion of the library and then testing the small molecules produced in the portion of the library for the presence or absence of the modified small molecule with the desired activity. The specific biocatalytic reactions which produce the modified small molecule of desired activity is optionally repeated. The biocatalytic reactions are conducted with a group of biocatalysts that react with distinct structural moieties found within the structure of a small molecule, each biocatalyst is specific for one structural moiety or a group of related structural moieties; and each biocatalyst reacts with many different small molecules which contain the distinct structural moiety.

Ammonia Lyase, e.g., Phenylalanine Ammonia Lyase, Tyrosine Ammonia Lyase and/or Histidine Ammonia Lyase Enzyme Signal Sequences, Prepro and Catalytic Domains The invention provides ammonia lyase, e.g., phenylalanine ammonia lyase, tyrosine ammonia lyase and/or histidine ammonia lyase enzyme signal sequences (e.g., signal peptides (SPs)), prepro domains and catalytic domains (CDs). The SPs, prepro domains and/or CDs of the invention can be isolated or recombinant peptides or can be part of a fusion protein, e.g., as a heterologous domain in a chimeric protein. The invention provides nucleic acids encoding these catalytic domains (CDs), prepro domains and signal sequences (SPs, e.g., a peptide having a sequence comprising/consisting of amino terminal residues of a polypeptide of the invention).

The invention provides isolated or recombinant signal sequences (e.g., signal peptides) consisting of or comprising a sequence as set forth in residues 1 to 11, 1 to 12, 1 to 13, 1 to 14, 1 to 15, 1 to 16, 1 to 17, 1 to 18, 1 to 19, 1 to 20, 1 to 21, 1 to 22, 1 to 23, 1 to 24, 1 to 25, 1 to 26, 1 to 27, 1 to 28, 1 to 28, 1 to 30, 1 to 31, 1 to 32, 1 to 33, 1 to 34, 1 to 35, 1 to 36, 1 to 37, 1 to 38, 1 to 40, 1 to 41, 1 to 42, 1 to 43, 1 to 44, 1 to 45, 1 to 46, 1 to 47, 1 to 48, 1 to 49, 1 to 50, or more, of a polypeptide of the invention, including the exemplary polypeptides of the invention, including all even-numbered sequences between SEQ ID NO:2 and SEQ ID NO:252. In one aspect, the invention provides signal sequences comprising the first 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70 or more amino terminal residues of a polypeptide of the invention.

Methods for identifying "prepro" domain sequences and signal sequences are well known in the art, see, e.g., Van de Ven (1993) Crit. Rev. Oncog. 4(2):115-136. For example, to identify a prepro sequence, the protein is purified from the extracellular space and the N-terminal protein sequence is determined and compared to the unprocessed form.

The invention includes polypeptides with or without a signal sequence and/or a prepro sequence. The invention includes polypeptides with heterologous signal sequences and/or prepro sequences. The prepro sequence (including a sequence of the invention used as a heterologous prepro domain) can be located on the amino terminal or the carboxy terminal end of the protein. The invention also includes isolated or recombinant signal sequences, prepro sequences and catalytic domains (e.g., "active sites") comprising sequences of the invention. The polypeptide comprising a signal sequence of the invention can be an ammonia lyase, e.g., phenylalanine ammonia lyase, tyrosine ammonia lyase and/or histidine ammonia lyase enzyme of the invention or another ammonia lyase, e.g., phenylalanine ammonia lyase, tyrosine ammonia lyase and/or histidine ammonia lyase enzyme or another enzyme or other polypeptide.

The ammonia lyase, e.g., phenylalanine ammonia lyase, tyrosine ammonia lyase and/or histidine ammonia lyase enzyme signal sequences (SPs) and/or prepro sequences of the invention can be isolated peptides, or, sequences joined to another ammonia lyase, e.g., phenylalanine ammonia lyase, tyrosine ammonia lyase and/or histidine ammonia lyase enzyme or a non-ammonia lyase, e.g., non-phenylalanine ammonia lyase, non-tyrosine ammonia lyase and/or non-histidine ammonia lyase polypeptide, e.g., as a fusion (chimeric) protein. In one aspect, the invention provides polypeptides comprising ammonia lyase, e.g., phenylalanine ammonia lyase, tyrosine ammonia lyase and/or histidine ammonia lyase enzyme signal sequences of the invention. In one aspect, polypeptides comprising ammonia lyase, e.g., phenylalanine ammonia lyase, tyrosine ammonia lyase and/or histidine ammonia lyase enzyme signal sequences SPs and/or prepro of the invention comprise sequences heterologous to an ammonia lyase, e.g., phenylalanine ammonia lyase, tyrosine ammonia lyase and/or histidine ammonia lyase enzyme of the invention (e.g., a fusion protein comprising an SP and/or prepro of the invention and sequences from another ammonia lyase, e.g., phenylalanine ammonia lyase, tyrosine ammonia lyase and/or histidine ammonia lyase enzyme or a non-ammonia lyase, e.g., non-phenylalanine ammonia lyase, non-tyrosine ammonia lyase and/or non-histidine ammonia lyase protein). In one aspect, the invention provides ammonia lyase, e.g., phenylalanine ammonia lyase, tyrosine ammonia lyase and/or histidine ammonia lyase enzymes of the invention with heterologous SPs and/or prepro sequences, e.g., sequences with a yeast signal sequence. An ammonia lyase, e.g., phenylalanine ammonia lyase, tyrosine ammonia lyase and/or histidine ammonia lyase enzyme of the invention can comprise a heterologous SP and/or prepro in a vector, e.g., a pPIC series vector (Invitrogen, Carlsbad, Calif.).

In one aspect, SPs and/or prepro sequences of the invention are identified following identification of novel ammonia lyase, e.g., phenylalanine ammonia lyase, tyrosine ammonia lyase and/or histidine ammonia lyase polypeptides. The pathways by which proteins are sorted and transported to their proper cellular location are often referred to as protein targeting pathways. One of the most important elements in all of these targeting systems is a short amino acid sequence at the amino terminus of a newly synthesized polypeptide called the signal sequence. This signal sequence directs a protein to its appropriate location in the cell and is removed during transport or when the protein reaches its final destination. Most lysosomal, membrane, or secreted proteins have an amino-terminal signal sequence that marks them for translocation into the lumen of the endoplasmic reticulum. The signal sequences can vary in length from about 10 to 65, or more, amino acid residues. Various methods of recognition of signal sequences are known to those of skill in the art. For example, in one aspect, novel ammonia lyase, e.g., phenylalanine ammonia lyase, tyrosine ammonia lyase and/or histidine ammonia lyase enzyme signal peptides are identified by a method referred to as SignalP. SignalP uses a combined neural network which recognizes both signal peptides and their cleavage sites. (Nielsen (1997) "Identification of prokaryotic and eukaryotic signal peptides and prediction of their cleavage sites." Protein Engineering 10:1-6.

It should be understood that in some aspects ammonia lyase, e.g., phenylalanine ammonia lyase, tyrosine ammonia lyase and/or histidine ammonia lyase enzymes of the invention may not have SPs and/or prepro sequences, or "domains." In one aspect, the invention provides the ammonia lyase, e.g., phenylalanine ammonia lyase, tyrosine ammonia lyase and/or histidine ammonia lyase enzymes of the invention lacking all or part of an SP and/or a prepro domain. In one aspect, the invention provides a nucleic acid sequence encoding a signal sequence (SP) and/or prepro from one ammonia lyase, e.g., phenylalanine ammonia lyase, tyrosine ammonia lyase and/or histidine ammonia lyase enzyme operably linked to a nucleic acid sequence of a different ammonia lyase, e.g., phenylalanine ammonia lyase, tyrosine ammonia lyase and/or histidine ammonia lyase enzyme or, optionally, a signal sequence (SPs) and/or prepro domain from a non-ammonia lyase, e.g., non-phenylalanine ammonia lyase, non-tyrosine ammonia lyase and/or non-histidine ammonia lyase protein may be desired.

The invention also provides isolated or recombinant polypeptides comprising signal sequences (SPs), prepro domain and/or catalytic domains (CDs) of the invention and heterologous sequences. The heterologous sequences are sequences not naturally associated (e.g., to a enzyme) with an SP, prepro domain and/or CD. The sequence to which the SP, prepro domain and/or CD are not naturally associated can be on the SP's, prepro domain and/or CD's amino terminal end, carboxy terminal end, and/or on both ends of the SP and/or CD. In one aspect, the invention provides an isolated or recombinant polypeptide comprising (or consisting of) a polypeptide comprising a signal sequence (SP), prepro domain and/or catalytic domain (CD) of the invention with the proviso that it is not associated with any sequence to which it is naturally associated (e.g., an ammonia lyase, e.g., phenylalanine ammonia lyase, tyrosine ammonia lyase and/or histidine ammonia lyase enzyme sequence). Similarly in one aspect, the invention provides isolated or recombinant nucleic acids encoding these polypeptides. Thus, in one aspect, the isolated or recombinant nucleic acid of the invention comprises coding sequence for a signal sequence (SP), prepro domain and/or catalytic domain (CD) of the invention and a heterologous sequence (i.e., a sequence not naturally associated with the a signal sequence (SP), prepro domain and/or catalytic domain (CD) of the invention). The heterologous sequence can be on the 3' terminal end, 5' terminal end, and/or on both ends of the SP, prepro domain and/or CD coding sequence.

Hybrid (Chimeric) Ammonia Lyase, e.g., Phenylalanine Ammonia Lyase, Tyrosine Ammonia Lyase and/or Histidine Ammonia Lyase Enzymes and Peptide Libraries In one aspect, the invention provides hybrid ammonia lyase, e.g., phenylalanine ammonia lyase, tyrosine ammonia lyase and/or histidine ammonia lyase enzymes and fusion proteins, including peptide libraries, comprising sequences of the invention. The peptide libraries of the invention can be used to isolate peptide modulators (e.g., activators or inhibitors) of targets, such as ammonia lyase, e.g., phenylalanine ammonia lyase, tyrosine ammonia lyase and/or histidine ammonia lyase enzyme substrates, receptors, enzymes. The peptide libraries of the invention can be used to identify formal binding partners of targets, such as ligands, e.g., cytokines, hormones and the like. In one aspect, the invention provides chimeric proteins comprising a signal sequence (SP), prepro domain and/or catalytic domain (CD) of the invention or a combination thereof and a heterologous sequence (see above).

In one aspect, the fusion proteins of the invention (e.g., the peptide moiety) are conformationally stabilized (relative to linear peptides) to allow a higher binding affinity for targets. The invention provides fusions of ammonia lyase, e.g., phenylalanine ammonia lyase, tyrosine ammonia lyase and/or histidine ammonia lyase enzymes of the invention and other peptides, including known and random peptides. They can be fused in such a manner that the structure of the ammonia lyase, e.g., phenylalanine ammonia lyase, tyrosine ammonia lyase and/or histidine ammonia lyase enzymes is not significantly perturbed and the peptide is metabolically or structurally conformationally stabilized. This allows the creation of a peptide library that is easily monitored both for its presence within cells and its quantity.

Amino acid sequence variants of the invention can be characterized by a predetermined nature of the variation, a feature that sets them apart from a naturally occurring form, e.g., an allelic or interspecies variation of an ammonia lyase, e.g., phenylalanine ammonia lyase, tyrosine ammonia lyase and/or histidine ammonia lyase enzyme sequence. In one aspect, the variants of the invention exhibit the same qualitative biological activity as the naturally occurring analogue. Alternatively, the variants can be selected for having modified characteristics. In one aspect, while the site or region for introducing an amino acid sequence variation is predetermined, the mutation per se need not be predetermined. For example, in order to optimize the performance of a mutation at a given site, random mutagenesis may be conducted at the target codon or region and the expressed ammonia lyase, e.g., phenylalanine ammonia lyase, tyrosine ammonia lyase and/or histidine ammonia lyase enzyme variants screened for the optimal combination of desired activity. Techniques for making substitution mutations at predetermined sites in DNA having a known sequence are well known, as discussed herein for example, M13 primer mutagenesis and PCR mutagenesis. Screening of the mutants can be done using, e.g., assays of glucan hydrolysis. In alternative aspects, amino acid substitutions can be single residues; insertions can be on the order of from about 1 to 20 amino acids, although considerably larger insertions can be done. Deletions can range from about 1 to about 20, 30, 40, 50, 60, 70 residues or more. To obtain a final derivative with the optimal properties, substitutions, deletions, insertions or any combination thereof may be used. Generally, these changes are done on a few amino acids to minimize the alteration of the molecule. However, larger changes may be tolerated in certain circumstances.

The invention provides ammonia lyase, e.g., phenylalanine ammonia lyase, tyrosine ammonia lyase and/or histidine ammonia lyase enzymes where the structure of the polypeptide backbone, the secondary or the tertiary structure, e.g., an alpha-helical or beta-sheet structure, has been modified. In one aspect, the charge or hydrophobicity has been modified. In one aspect, the bulk of a side chain has been modified. Substantial changes in function or immunological identity are made by selecting substitutions that are less conservative. For example, substitutions can be made which more significantly affect: the structure of the polypeptide backbone in the area of the alteration, for example a alpha-helical or a beta-sheet structure; a charge or a hydrophobic site of the molecule, which can be at an active site; or a side chain. The invention provides substitutions in polypeptide of the invention where (a) a hydrophilic residues, e.g. seryl or threonyl, is substituted for (or by) a hydrophobic residue, e.g. leucyl, isoleucyl, phenylalanyl, valyl or alanyl; (b) a cysteine or proline is substituted for (or by) any other residue; (c) a residue having an electropositive side chain, e.g. lysyl, arginyl, or histidyl, is substituted for (or by) an electronegative residue, e.g. glutamyl or aspartyl; or (d) a residue having a bulky side chain, e.g. phenylalanine, is substituted for (or by) one not having a side chain, e.g. glycine. The variants can exhibit the same qualitative biological activity (i.e., an ammonia lyase, e.g., phenylalanine ammonia lyase, tyrosine ammonia lyase and/or histidine ammonia lyase enzyme activity) although variants can be selected to modify the characteristics of the ammonia lyase, e.g., phenylalanine ammonia lyase, tyrosine ammonia lyase and/or histidine ammonia lyase enzymes as needed.

In one aspect, ammonia lyase, e.g., phenylalanine ammonia lyase, tyrosine ammonia lyase and/or histidine ammonia lyase enzymes of the invention comprise epitopes or purification tags, signal sequences or other fusion sequences, etc. In one aspect, the ammonia lyase, e.g., phenylalanine ammonia lyase, tyrosine ammonia lyase and/or histidine ammonia lyase enzymes of the invention can be fused to a random peptide to form a fusion polypeptide. By "fused" or "operably linked" herein is meant that the random peptide and the ammonia lyase, e.g., phenylalanine ammonia lyase, tyrosine ammonia lyase and/or histidine ammonia lyase enzyme are linked together, in such a manner as to minimize the disruption to the stability of the ammonia lyase, e.g., phenylalanine ammonia lyase, tyrosine ammonia lyase and/or histidine ammonia lyase enzyme structure, e.g., it retains ammonia lyase, e.g., phenylalanine ammonia lyase, tyrosine ammonia lyase and/or histidine ammonia lyase enzyme activity. The fusion polypeptide (or fusion polynucleotide encoding the fusion polypeptide) can comprise further components as well, including multiple peptides at multiple loops.

In one aspect, the peptides and nucleic acids encoding them are randomized, either fully randomized or they are biased in their randomization, e.g. in nucleotide/residue frequency generally or per position. "Randomized" means that each nucleic acid and peptide consists of essentially random nucleotides and amino acids, respectively. In one aspect, the nucleic acids which give rise to the peptides can be chemically synthesized, and thus may incorporate any nucleotide at any position. Thus, when the nucleic acids are expressed to form peptides, any amino acid residue may be incorporated at any position. The synthetic process can be designed to generate randomized nucleic acids, to allow the formation of all or most of the possible combinations over the length of the nucleic acid, thus forming a library of randomized nucleic acids. The library can provide a sufficiently structurally diverse population of randomized expression products to affect a probabilistically sufficient range of cellular responses to provide one or more cells exhibiting a desired response. Thus, the invention provides an interaction library large enough so that at least one of its members will have a structure that gives it affinity for some molecule, protein, or other factor.

In one aspect, an ammonia lyase, e.g., phenylalanine ammonia lyase, tyrosine ammonia lyase and/or histidine ammonia lyase enzyme of the invention is a multidomain enzyme that comprises a signal peptide, a carbohydrate binding module, an ammonia lyase, e.g., phenylalanine ammonia lyase, tyrosine ammonia lyase and/or histidine ammonia lyase enzyme catalytic domain, a linker and/or another catalytic domain.

The invention provides a means for generating chimeric polypeptides which may encode biologically active hybrid polypeptides (e.g., hybrid ammonia lyase, e.g., phenylalanine ammonia lyase, tyrosine ammonia lyase and/or histidine ammonia lyase enzymes). In one aspect, the original polynucleotides encode biologically active polypeptides. The method of the invention produces new hybrid polypeptides by utilizing cellular processes which integrate the sequence of the original polynucleotides such that the resulting hybrid polynucleotide encodes a polypeptide demonstrating activities derived from the original biologically active polypeptides. For example, the original polynucleotides may encode a particular enzyme from different microorganisms. An enzyme encoded by a first polynucleotide from one organism or variant may, for example, function effectively under a particular environmental condition, e.g. high salinity. An enzyme encoded by a second polynucleotide from a different organism or variant may function effectively under a different environmental condition, such as extremely high temperatures. A hybrid polynucleotide containing sequences from the first and second original polynucleotides may encode an enzyme which exhibits characteristics of both enzymes encoded by the original polynucleotides. Thus, the enzyme encoded by the hybrid polynucleotide may function effectively under environmental conditions shared by each of the enzymes encoded by the first and second polynucleotides, e.g., high salinity and extreme temperatures.

A hybrid polypeptide resulting from the method of the invention may exhibit specialized enzyme activity not displayed in the original enzymes. For example, following recombination and/or reductive reassortment of polynucleotides encoding ammonia lyase, e.g., phenylalanine ammonia lyase, tyrosine ammonia lyase and/or histidine ammonia lyase enzymes, the resulting hybrid polypeptide encoded by a hybrid polynucleotide can be screened for specialized non-ammonia lyase, e.g., non-phenylalanine ammonia lyase, non-tyrosine ammonia lyase and/or non-histidine ammonia lyase enzyme activities, e.g., hydrolase, peptidase, phosphorylase, etc., activities, obtained from each of the original enzymes. Thus, for example, the hybrid polypeptide may be screened to ascertain those chemical functionalities which distinguish the hybrid polypeptide from the original parent polypeptides, such as the temperature, pH or salt concentration at which the hybrid polypeptide functions.

In one aspect, the invention relates to a method for producing a biologically active hybrid polypeptide and screening such a polypeptide for enhanced activity by:
1) introducing at least a first polynucleotide in operable linkage and a second polynucleotide in operable linkage, the at least first polynucleotide and second polynucleotide sharing at least one region of partial sequence homology, into a suitable host cell;
2) growing the host cell under conditions which promote sequence reorganization resulting in a hybrid polynucleotide in operable linkage;
3) expressing a hybrid polypeptide encoded by the hybrid polynucleotide;
4) screening the hybrid polypeptide under conditions which promote identification of enhanced biological activity; and
5) isolating the a polynucleotide encoding the hybrid polypeptide.

Isolating and Discovering Ammonia Lyase, e.g., Phenylalanine Ammonia Lyase, Tyrosine Ammonia Lyase and/or Histidine Ammonia Lyase Enzymes The invention provides methods for isolating and discovering ammonia lyase, e.g., phenylalanine ammonia lyase, tyrosine ammonia lyase and/or histidine ammonia lyase enzymes and the nucleic acids that encode them. Polynucleotides or enzymes may be isolated from individual organisms ("isolates"), collections of organisms that have been grown in defined media ("enrichment cultures"), or, uncultivated organisms ("environmental samples"). The organisms can be isolated by, e.g., in vivo biopanning (see discussion, below). The use of a culture-independent approach to derive polynucleotides encoding novel bioactivities from environmental samples is most preferable since it allows one to access untapped resources of biodiversity. Polynucleotides or enzymes also can be isolated from any one of numerous organisms, e.g. bacteria. In addition to whole cells, polynucleotides or enzymes also can be isolated from crude enzyme preparations derived from cultures of these organisms, e.g., bacteria.

"Environmental libraries" are generated from environmental samples and represent the collective genomes of naturally occurring organisms archived in cloning vectors that can be propagated in suitable prokaryotic hosts. Because the cloned DNA is initially extracted directly from environmental samples, the libraries are not limited to the small fraction of prokaryotes that can be grown in pure culture. Additionally, a normalization of the environmental DNA present in these samples could allow more equal representation of the DNA from all of the species present in the original sample. This can dramatically increase the efficiency of finding interesting genes from minor constituents of the sample which may be under-represented by several orders of magnitude compared to the dominant species.

For example, gene libraries generated from one or more uncultivated microorganisms are screened for an activity of interest. Potential pathways encoding bioactive molecules of interest are first captured in prokaryotic cells in the form of gene expression libraries. Polynucleotides encoding activities of interest are isolated from such libraries and introduced into a host cell. The host cell is grown under conditions which promote recombination and/or reductive reassortment creating potentially active biomolecules with novel or enhanced activities.

In vivo biopanning may be performed utilizing a FACS-based and non-optical (e.g., magnetic) based machines. Complex gene libraries are constructed with vectors which contain elements which stabilize transcribed RNA. For example, the inclusion of sequences which result in secondary structures such as hairpins which are designed to flank the transcribed regions of the RNA would serve to enhance their stability, thus increasing their half life within the cell. The probe molecules used in the biopanning process consist of oligonucleotides labeled with reporter molecules that only fluoresce upon binding of the probe to a target molecule. These probes are introduced into the recombinant cells from the library using one of several transformation methods. The probe molecules bind to the transcribed target mRNA resulting in DNA/RNA heteroduplex molecules. Binding of the probe to a target will yield a fluorescent signal which is detected and sorted by the FACS machine during the screening process.

Additionally, subcloning may be performed to further isolate sequences of interest. In subcloning, a portion of DNA is amplified, digested, generally by restriction enzymes, to cut out the desired sequence, the desired sequence is ligated into a recipient vector and is amplified. At each step in subcloning, the portion is examined for the activity of interest, in order to ensure that DNA that encodes the structural protein has not been excluded. The insert may be purified at any step of the subcloning, for example, by gel electrophoresis prior to ligation into a vector or where cells containing the recipient vector and cells not containing the recipient vector are placed on selective media containing, for example, an antibiotic, which will kill the cells not containing the recipient vector. Specific methods of subcloning cDNA inserts into vectors are well-known in the art (Sambrook et al, Molecular Cloning: A Laboratory Manual, 2nd Ed., Cold Spring Harbor Laboratory Press (1989)). In another aspect, the enzymes of the invention are subclones. Such subclones may differ from the parent clone by, for example, length, a mutation, a tag or a label.

In one aspect, the signal sequences of the invention are identified following identification of novel ammonia lyase, e.g., phenylalanine ammonia lyase, tyrosine ammonia lyase and/or histidine ammonia lyase polypeptides. The pathways by which proteins are sorted and transported to their proper cellular location are often referred to as protein targeting pathways. One of the most important elements in all of these targeting systems is a short amino acid sequence at the amino terminus of a newly synthesized polypeptide called the signal sequence. This signal sequence directs a protein to its appropriate location in the cell and is removed during transport or when the protein reaches its final destination. Most lysosomal, membrane, or secreted proteins have an amino-terminal signal sequence that marks them for translocation into the lumen of the endoplasmic reticulum. More than 100 signal sequences for proteins in this group have been determined. The sequences vary in length from 13 to 36 amino acid residues. Various methods of recognition of signal sequences are known to those of skill in the art. In one aspect, the peptides are identified by a method referred to as SignalP. SignalP uses a combined neural network which recognizes both signal peptides and their cleavage sites. See, e.g., Nielsen (1997) "Identification of prokaryotic and eukaryotic signal peptides and prediction of their cleavage sites." Protein Engineering, vol. 10, no. 1, p. 1-6. It should be understood that some of the ammonia lyase, e.g., phenylalanine ammonia lyase, tyrosine ammonia lyase and/or histidine ammonia lyase enzymes of the invention may or may not contain signal sequences. It may be desirable to include a nucleic acid sequence encoding a signal sequence from one ammonia lyase, e.g., phenylalanine ammonia lyase, tyrosine ammonia lyase and/or histidine ammonia lyase enzyme operably linked to a nucleic acid sequence of a different ammonia lyase, e.g., phenylalanine ammonia lyase, tyrosine ammonia lyase and/or histidine ammonia lyase enzyme or, optionally, a signal sequence from a non-ammonia lyase, e.g., phenylalanine ammonia lyase, tyrosine ammonia lyase and/or histidine ammonia lyase protein may be desired.

The microorganisms from which the polynucleotide may be discovered, isolated or prepared include prokaryotic microorganisms, such as *Eubacteria* and *Archaebacteria* and lower eukaryotic microorganisms such as fungi, some algae and protozoa. Polynucleotides may be discovered, isolated or prepared from environmental samples in which case the nucleic acid may be recovered without culturing of an organism or recovered from one or more cultured organisms, hi one aspect, such microorganisms may be extremophiles, such as hyperthermophiles, psychrophiles, psychrotrophs, halophiles, barophiles and acidophiles. Polynucleotides encoding enzymes isolated from extremophilic microorganisms can be used. Such enzymes may function at temperatures above 100° C. in terrestrial hot springs and deep sea thermal vents, at temperatures below 0° C. in arctic waters, in the saturated salt environment of the Dead Sea, at pH values around 0 in coal deposits and geothermal sulfur-rich springs, or at pH values greater than 11 in sewage sludge. For example, several esterases and lipases cloned and expressed from extremophilic organisms show high activity throughout a wide range of temperatures and pHs.

Polynucleotides selected and isolated as hereinabove described are introduced into a suitable host cell. A suitable host cell is any cell which is capable of promoting recombination and/or reductive reassortment. The selected polynucleotides are in one aspect already in a vector which includes appropriate control sequences. The host cell can be a higher eukaryotic cell, such as a mammalian cell, or a lower eukaryotic cell, such as a yeast cell, or in one aspect, the host cell can be a prokaryotic cell, such as a bacterial cell. Introduction of the construct into the host cell can be effected by calcium phosphate transfection, DEAE-Dextran mediated transfection, or electroporation (Davis et al., 1986).

As representative examples of appropriate hosts, there may be mentioned: bacterial cells, such as *E. coli, Streptomyces, Salmonella typhimurium*; fungal cells, such as yeast; insect cells such as *Drosophila* S2 and *Spodoptera* SJ9; animal cells such as CHO, COS or Bowes melanoma; adenoviruses; and plant cells. The selection of an appropriate host is deemed to be within the scope of those skilled in the art from the teachings herein.

With particular references to various mammalian cell culture systems that can be employed to express recombinant protein, examples of mammalian expression systems include the COS-7 lines of monkey kidney fibroblasts, described in "SV40-transformed simian cells support the replication of early SV40 mutants" (Gluzman, 1981) and other cell lines capable of expressing a compatible vector, for example, the C127, 3T3, CHO, HeLa and BHK cell lines. Mammalian expression vectors will comprise an origin of replication, a suitable promoter and enhancer and also any necessary ribosome binding sites, polyadenylation site, splice donor and acceptor sites, transcriptional termination sequences and 5' flanking nontranscribed sequences. DNA sequences derived from the SV40 splice and polyadenylation sites may be used to provide the required nontranscribed genetic elements.

In another aspect, it is envisioned the method of the present invention can be used to generate novel polynucleotides encoding biochemical pathways from one or more operons or gene clusters or portions thereof. For example, bacteria and many eukaryotes have a coordinated mechanism for regulating genes whose products are involved in related processes. The genes are clustered, in structures referred to as "gene clusters," on a single chromosome and are transcribed together under the control of a single regulatory sequence, including a single promoter which initiates transcription of the entire cluster. Thus, a gene cluster is a group of adjacent genes that are either identical or related, usually as to their function. An example of a biochemical pathway encoded by gene clusters are polyketides.

Gene cluster DNA can be isolated from different organisms and ligated into vectors, particularly vectors containing expression regulatory sequences which can control and regulate the production of a detectable protein or protein-related array activity from the ligated gene clusters. Use of vectors which have an exceptionally large capacity for exogenous DNA introduction are particularly appropriate for use with such gene clusters and are described by way of example herein to include the f-factor (or fertility factor) of *E. coli*. This f-factor of *E. coli* is a plasmid which affects high-frequency transfer of itself during conjugation and is ideal to achieve and stably propagate large DNA fragments, such as gene clusters from mixed microbial samples. One aspect is to use cloning vectors, referred to as "fosmids" or bacterial artificial chromosome (BAC) vectors. These are derived from E. coli f-factor which is able to stably integrate large segments of genomic DNA. When integrated with DNA from a mixed uncultured environmental sample, this makes it possible to achieve large genomic fragments in the form of a stable "environmental DNA library." Another type of vector for use in the present invention is a cosmid vector. Cosmid vectors were originally designed to clone and propagate large segments of genomic DNA. Cloning into cosmid vectors is described in detail in Sambrook et ah, Molecular Cloning: A Laboratory Manual, 2nd Ed., Cold Spring Harbor Laboratory Press (1989). Once ligated into an appropriate vector, two or more vectors containing different polyketide synthase gene clusters can be introduced into a suitable host cell. Regions of partial sequence homology shared by the gene clusters will promote processes which result in sequence reorganization resulting in a hybrid gene cluster. The novel hybrid gene cluster can then be screened for enhanced activities not found in the original gene clusters.

Methods for screening for various enzyme activities are known to those of skill in the art and are discussed throughout the present specification, see, e.g., Examples 1, 2 and 3, below. Such methods may be employed when isolating the polypeptides and polynucleotides of the invention.

In one aspect, the invention provides methods for discovering and isolating ammonia lyase, e.g., phenylalanine ammonia lyase, tyrosine ammonia lyase and/or histidine ammonia lyase, or compounds to modify the activity of these enzymes, using a whole cell approach. Putative clones encoding ammonia lyase, e.g., phenylalanine ammonia lyase, tyrosine ammonia lyase and/or histidine ammonia lyase from genomic DNA library can be screened.

Screening Methodologies and "on-Line" Monitoring Devices

In practicing the methods of the invention, a variety of apparatus and methodologies can be used to in conjunction with the polypeptides and nucleic acids of the invention, e.g., to screen polypeptides for ammonia lyase, e.g., phenylalanine ammonia lyase, tyrosine ammonia lyase and/or histidine ammonia lyase enzyme activity, to screen compounds as potential modulators, e.g., activators or inhibitors, of an ammonia lyase, e.g., phenylalanine ammonia lyase, tyrosine ammonia lyase and/or histidine ammonia lyase enzyme activity, for antibodies that bind to a polypeptide of the invention, for nucleic acids that hybridize to a nucleic acid of the invention, to screen for cells expressing a polypeptide of the invention and the like. In addition to the array formats described in detail below for screening samples, alternative formats can also be used to practice the methods of the invention. Such formats include, for example, mass spectrometers, chromatographs, e.g., high-throughput HPLC and other forms of liquid chromatography, and smaller formats, such as 1536-well plates, 384-well plates and so on. High throughput screening apparatus can be adapted and used to practice the methods of the invention, see, e.g., U.S. Patent Application No. 20020001809.

The terms "array" or "microarray" or "biochip" or "chip" as used herein is a plurality of target elements, each target element comprising a defined amount of one or more polypeptides (including antibodies) or nucleic acids immobilized onto a defined area of a substrate surface, as discussed in further detail, below.

Capillary Arrays

Nucleic acids or polypeptides of the invention can be immobilized to or applied to an array. Arrays can be used to screen for or monitor libraries of compositions (e.g., small molecules, antibodies, nucleic acids, etc.) for their ability to bind to or modulate the activity of a nucleic acid or a polypeptide of the invention. Capillary arrays, such as the GIGAMATRIX™, Diversa Corporation, San Diego, Calif.; and arrays described in, e.g., U.S. Patent Application No. 20020080350 A1; WO 0231203 A; WO 0244336 A, provide an alternative apparatus for holding and screening samples. In one aspect, the capillary array includes a plurality of capillaries formed into an array of adjacent capillaries, wherein each capillary comprises at least one wall defining a lumen for retaining a sample. The lumen may be cylindrical, square, hexagonal or any other geometric shape so long as the walls form a lumen for retention of a liquid or sample. The capillaries of the capillary array can be held together in close proximity to form a planar structure. The capillaries can be bound together, by being fused (e.g., where the capillaries are made of glass), glued, bonded, or clamped side-by-side. Additionally, the capillary array can include interstitial material disposed between adjacent capillaries in the array, thereby forming a solid planar device containing a plurality of through-holes.

A capillary array can be formed of any number of individual capillaries, for example, a range from 100 to 4,000,000 capillaries. Further, a capillary array having about 100,000 or more individual capillaries can be formed into the standard size and shape of a Microtiter® plate for fitment into standard laboratory equipment. The lumens are filled manually or automatically using either capillary action or microinjection using a thin needle. Samples of interest may subsequently be removed from individual capillaries for further analysis or characterization. For example, a thin, needle-like probe is positioned in fluid communication with a selected capillary to either add or withdraw material from the lumen.

In a single-pot screening assay, the assay components are mixed yielding a solution of interest, prior to insertion into the capillary array. The lumen is filled by capillary action when at least a portion of the array is immersed into a solution of interest. Chemical or biological reactions and/or activity in each capillary are monitored for detectable events. A detectable event is often referred to as a "hit", which can usually be distinguished from "non-hit" producing capillaries by optical detection. Thus, capillary arrays allow for massively parallel detection of "hits".

In a multi-pot screening assay, a polypeptide or nucleic acid, e.g., a ligand, can be introduced into a first component, which is introduced into at least a portion of a capillary of a capillary array. An air bubble can then be introduced into the capillary behind the first component. A second component can then be introduced into the capillary, wherein the second component is separated from the first component by the air bubble. The first and second components can then be mixed by applying hydrostatic pressure to both sides of the capillary array to collapse the bubble. The capillary array is then monitored for a detectable event resulting from reaction or non-reaction of the two components.

In a binding screening assay, a sample of interest can be introduced as a first liquid labeled with a detectable particle into a capillary of a capillary array, wherein the lumen of the capillary is coated with a binding material for binding the detectable particle to the lumen. The first liquid may then be removed from the capillary tube, wherein the bound detectable particle is maintained within the capillary, and a second liquid may be introduced into the capillary tube. The capillary is then monitored for a detectable event resulting from reaction or non-reaction of the particle with the second liquid.

Arrays, or "Biochips"

Nucleic acids or polypeptides of the invention can be immobilized to or applied to an array. Arrays can be used to screen for or monitor libraries of compositions (e.g., small molecules, antibodies, nucleic acids, etc.) for their ability to bind to or modulate the activity of a nucleic acid or a polypeptide of the invention. For example, in one aspect of the invention, a monitored parameter is transcript expression of an ammonia lyase, e.g., phenylalanine ammonia lyase, tyrosine ammonia lyase and/or histidine ammonia lyase enzyme gene. One or more, or, all the transcripts of a cell can be measured by hybridization of a sample comprising transcripts of the cell, or, nucleic acids representative of or complementary to transcripts of a cell, by hybridization to immobilized nucleic acids on an array, or "biochip." By using an "array" of nucleic acids on a microchip, some or all of the transcripts of a cell can be simultaneously quantified. Alternatively, arrays comprising genomic nucleic acid can also be used to determine the genotype of a newly engineered strain made by the methods of the invention. Polypeptide arrays" can also be used to simultaneously quantify a plurality of proteins. The present invention can be practiced with any known "array," also referred to as a "microarray" or "nucleic acid array" or "polypeptide array" or "antibody array" or "biochip," or variation thereof. Arrays are genetically a plurality of "spots" or "target elements," each target element comprising a defined amount of one or more biological molecules, e.g., oligonucleotides, immobilized onto a defined area of a substrate surface for specific binding to a sample molecule, e.g., mRNA transcripts.

In practicing the methods of the invention, any known array and/or method of making and using arrays can be incorporated in whole or in part, or variations thereof, as described, for example, in U.S. Pat. Nos. 6,277,628; 6,277,489; 6,261, 776; 6,258,606; 6,054,270; 6,048,695; 6,045,996; 6,022,963; 6,013,440; 5,965,452; 5,959,098; 5,856,174; 5,830,645; 5,770,456; 5,632,957; 5,556,752; 5,143,854; 5,807,522; 5,800,992; 5,744,305; 5,700,637; 5,556,752; 5,434,049; see also, e.g., WO 99/51773; WO 99/09217; WO 97/46313; WO 96/17958; see also, e.g., Johnston (1998) Curr. Biol. 8:R171—R174; Schummer (1997) Biotechniques 23:1087-1092; Kern (1997) Biotechniques 23:120-124; Solinas-Toldo (1997) Genes, Chromosomes & Cancer 20:399-407; Bowtell (1999) Nature Genetics Supp. 21:25-32. See also published U.S. patent applications Nos. 20010018642; 20010019827; 20010016322; 20010014449; 20010014448; 20010012537; 20010008765.

Antibodies and Antibody-Based Screening Methods

The invention provides isolated or recombinant antibodies that specifically bind to an ammonia lyase, e.g., phenylalanine ammonia lyase, tyrosine ammonia lyase and/or histidine ammonia lyase enzyme of the invention. These antibodies can be used to isolate, identify or quantify the ammonia lyase, e.g., phenylalanine ammonia lyase, tyrosine ammonia lyase and/or histidine ammonia lyase enzymes of the invention or related polypeptides. These antibodies can be used to isolate other polypeptides within the scope the invention or other related ammonia lyase, e.g., phenylalanine ammonia lyase, tyrosine ammonia lyase and/or histidine ammonia lyase enzymes. The antibodies can be designed to bind to an active site of an ammonia lyase, e.g., phenylalanine ammonia lyase, tyrosine ammonia lyase and/or histidine ammonia lyase enzyme. Thus, the invention provides methods of inhibiting ammonia lyase, e.g., phenylalanine ammonia lyase, tyrosine ammonia lyase and/or histidine ammonia lyase enzymes using the antibodies of the invention (see discussion above regarding applications for anti-ammonia lyase, e.g., anti-phenylalanine ammonia lyase, anti-tyrosine ammonia lyase and/or anti-histidine ammonia lyase enzyme compositions of the invention).

The term "antibody" includes a peptide or polypeptide derived from, modeled after or substantially encoded by an immunoglobulin gene or immunoglobulin genes, or fragments thereof, capable of specifically binding an antigen or epitope, see, e.g. Fundamental Immunology, Third Edition, W. E. Paul, ed., Raven Press, N.Y. (1993); Wilson (1994) J. Immunol. Methods 175:267-273; Yarmush (1992) J. Biochem. Biophys. Methods 25:85-97. The term antibody includes antigen-binding portions, i.e., "antigen binding sites," (e.g., fragments, subsequences, complementarity determining regions (CDRs)) that retain capacity to bind antigen, including (i) a Fab fragment, a monovalent fragment consisting of the VL, VH, CL and CH1 domains; (ii) a F(ab')2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) Nature 341-0.544-546), which consists of a VH domain; and (vi) an isolated complementarity determining region (CDR). Single chain antibodies are also included by reference in the term "antibody."

The invention provides subsequences of polypeptides of the invention, e.g., enzymatically active or immunogenic fragments of the enzymes of the invention, including immunogenic fragments of a polypeptide of the invention. The invention provides compositions comprising a polypeptide or peptide of the invention and adjuvants or carriers and the like.

The antibodies can be used in immunoprecipitation, staining, immunoaffinity columns, and the like. If desired, nucleic acid sequences encoding for specific antigens can be generated by immunization followed by isolation of polypeptide or nucleic acid, amplification or cloning and immobilization of polypeptide onto an array of the invention. Alternatively, the methods of the invention can be used to modify the structure of an antibody produced by a cell to be modified, e.g., an antibody's affinity can be increased or decreased. Furthermore, the ability to make or modify antibodies can be a phenotype engineered into a cell by the methods of the invention.

Methods of immunization, producing and isolating antibodies (polyclonal and monoclonal) are known to those of skill in the art and described in the scientific and patent literature, see, e.g., Coligan, CURRENT PROTOCOLS IN IMMUNOLOGY, Wiley/Greene, NY (1991); Stites (eds.) BASIC AND CLINICAL IMMUNOLOGY (7th ed.) Lange Medical Publications, Los Altos, Calif. ("Stites"); Goding, MONOCLONAL ANTIBODIES: PRINCIPLES AND PRACTICE (2d ed.) Academic Press, New York, N.Y. (1986); Kohler (1975) Nature 256:495; Harlow (1988) ANTIBODIES, A LABORATORY MANUAL, Cold Spring Harbor Publications, New York. Antibodies also can be generated in vitro, e.g., using recombinant antibody binding site expressing phage display libraries, in addition to the traditional in vivo methods using animals. See, e.g., Hoogenboom (1997) Trends Biotechnol. 15:62-70; Katz (1997) Annu. Rev. Biophys. Biomol. Struct. 26:27-45.

The polypeptides of the invention or fragments comprising at least 5, 10, 15, 20, 25, 30, 35, 40, 50, 75, 100, or 150 consecutive amino acids thereof, may also be used to generate antibodies which bind specifically to the polypeptides or fragments. The resulting antibodies may be used in immunoaffinity chromatography procedures to isolate or purify the polypeptide or to determine whether the polypeptide is present in a biological sample. In such procedures, a protein preparation, such as an extract, or a biological sample is contacted with an antibody capable of specifically binding to one of the polypeptides of the invention, or fragments comprising at least 5, 10, 15, 20, 25, 30, 35, 40, 50, 75, 100, or 150 consecutive amino acids thereof.

In immunoaffinity procedures, the antibody is attached to a solid support, such as a bead or other column matrix. The protein preparation is placed in contact with the antibody under conditions in which the antibody specifically binds to one of the polypeptides of the invention, or fragment thereof. After a wash to remove non-specifically bound proteins, the specifically bound polypeptides are eluted.

The ability of proteins in a biological sample to bind to the antibody may be determined using any of a variety of procedures familiar to those skilled in the art. For example, binding may be determined by labeling the antibody with a detectable label such as a fluorescent agent, an enzymatic label, or a radioisotope. Alternatively, binding of the antibody to the sample may be detected using a secondary antibody having such a detectable label thereon. Particular assays include ELISA assays, sandwich assays, radioimmunoassays and Western Blots.

Polyclonal antibodies generated against the polypeptides of the invention, or fragments comprising at least 5, 10, 15, 20, 25, 30, 35, 40, 50, 75, 100, or 150 consecutive amino acids thereof can be obtained by direct injection of the polypeptides into an animal or by administering the polypeptides to an animal, for example, a nonhuman. The antibody so obtained can bind the polypeptide itself. In this manner, even a sequence encoding only a fragment of the polypeptide can be used to generate antibodies which may bind to the whole native polypeptide. Such antibodies can then be used to isolate the polypeptide from cells expressing that polypeptide.

For preparation of monoclonal antibodies, any technique which provides antibodies produced by continuous cell line cultures can be used. Examples include the hybridoma technique (Kohler and Milstein, Nature, 256:495-497, 1975), the trioma technique, the human B-cell hybridoma technique (Kozbor et al, immunology Today 4:72, 1983) and the EBV-hybridoma technique (Cole, et al, 1985, in Monoclonal Antibodies and Cancer Therapy, Alan R. Liss, Inc., pp. 77-96).

Techniques described for the production of single chain antibodies (U.S. Pat. No. 4,946,778) can be adapted to produce single chain antibodies to the polypeptides of the invention, or fragments comprising at least 5, 10, 15, 20, 25, 30, 35, 40, 50, 75, 100, or 150 consecutive amino acids thereof. Alternatively, transgenic mice may be used to express humanized antibodies to these polypeptides or fragments thereof.

Antibodies generated against the polypeptides of the invention, or fragments comprising at least 5, 10, 15, 20, 25, 30, 35, 40, 50, 75, 100, or 150 consecutive amino acids thereof may be used in screening for similar polypeptides from other organisms and samples. In such techniques, polypeptides from the organism are contacted with the antibody and those polypeptides which specifically bind the antibody are detected. Any of the procedures described above may be used to detect antibody binding. One such screening assay is described in "Methods for Measuring Cellulase Activities", *Methods in Enzymology*, Vol 160, pp. 87-116.

Kits

The invention provides kits comprising the compositions, e.g., nucleic acids, expression cassettes, vectors, cells, transgenic seeds or plants or plant parts, polypeptides (e.g., an ammonia lyase enzyme) and/or antibodies of the invention. The kits also can contain instructional material teaching the methodologies and industrial uses of the invention, as described herein.

Whole Cell Engineering and Measuring Metabolic Parameters

The methods of the invention provide whole cell evolution, or whole cell engineering, of a cell to develop a new cell strain having a new phenotype, e.g., a new or modified ammonia lyase, e.g., phenylalanine ammonia lyase, tyrosine ammonia lyase and/or histidine ammonia lyase enzyme activity, by modifying the genetic composition of the cell. The genetic composition can be modified by addition to the cell of a nucleic acid of the invention, e.g., a coding sequence for an enzyme of the invention. See, e.g., WO0229032; WO0196551.

To detect the new phenotype, at least one metabolic parameter of a modified cell is monitored in the cell in a "real time" or "on-line" time frame. In one aspect, a plurality of cells, such as a cell culture, is monitored in "real time" or "on-line." In one aspect, a plurality of metabolic parameters is monitored in "real time" or "on-line." Metabolic parameters can be monitored using the ammonia lyase, e.g., phenylalanine ammonia lyase, tyrosine ammonia lyase and/or histidine ammonia lyase enzymes of the invention.

Metabolic flux analysis (MFA) is based on a known biochemistry framework. A linearly independent metabolic matrix is constructed based on the law of mass conservation and on the pseudo-steady state hypothesis (PSSH) on the intracellular metabolites. In practicing the methods of the invention, metabolic networks are established, including the:

identity of all pathway substrates, products and intermediary metabolites identity of all the chemical reactions interconverting the pathway metabolites, the stoichiometry of the pathway reactions, identity of all the enzymes catalyzing the reactions, the enzyme reaction kinetics, the regulatory interactions between pathway components, e.g. allosteric interactions, enzyme-enzyme interactions etc, intracellular compartmentalization of enzymes or any other supramolecular organization of the enzymes, and, the presence of any concentration gradients of metabolites, enzymes or effector molecules or diffusion barriers to their movement.

Once the metabolic network for a given strain is built, mathematic presentation by matrix notion can be introduced to estimate the intracellular metabolic fluxes if the on-line metabolome data is available. Metabolic phenotype relies on the changes of the whole metabolic network within a cell. Metabolic phenotype relies on the change of pathway utilization with respect to environmental conditions, genetic regulation, developmental state and the genotype, etc. In one aspect of the methods of the invention, after the on-line MFA calculation, the dynamic behavior of the cells, their phenotype and other properties are analyzed by investigating the pathway utilization. For example, if the glucose supply is increased and the oxygen decreased during the yeast fermentation, the utilization of respiratory pathways will be reduced and/or stopped, and the utilization of the fermentative pathways will dominate. Control of physiological state of cell cultures will become possible after the pathway analysis. The methods of the invention can help determine how to manipulate the fermentation by determining how to change the substrate supply, temperature, use of inducers, etc. to control the physiological state of cells to move along desirable direction. In practicing the methods of the invention, the MFA results can also be compared with transcriptome and proteome data to design experiments and protocols for metabolic engineering or gene shuffling, etc.

In practicing the methods of the invention, any modified or new phenotype can be conferred and detected, including new or improved characteristics in the cell. Any aspect of metabolism or growth can be monitored.

Monitoring Expression of an mRNA Transcript

In one aspect of the invention, the engineered phenotype comprises increasing or decreasing the expression of an mRNA transcript (e.g., an ammonia lyase, e.g., phenylalanine ammonia lyase, tyrosine ammonia lyase and/or histidine ammonia lyase enzyme message) or generating new (e.g., ammonia lyase, e.g., phenylalanine ammonia lyase, tyrosine ammonia lyase and/or histidine ammonia lyase enzyme) transcripts in a cell. This increased or decreased expression can be traced by testing for the presence of an ammonia lyase, e.g., phenylalanine ammonia lyase, tyrosine ammonia lyase and/or histidine ammonia lyase enzyme of the invention or by ammonia lyase, e.g., phenylalanine ammonia lyase, tyrosine ammonia lyase and/or histidine ammonia lyase enzyme activity assays. mRNA transcripts, or messages, also can be detected and quantified by any method known in the art, including, e.g., Northern blots, quantitative amplification reactions, hybridization to arrays, and the like. Quantitative amplification reactions include, e.g., quantitative PCR, including, e.g., quantitative reverse transcription polymerase chain reaction, or RT-PCR; quantitative real time RT-PCR, or "real-time kinetic RT-PCR" (see, e.g., Kreuzer (2001) Br. J. Haematol. 114:313-318; Xia (2001) Transplantation 72:907-914).

In one aspect of the invention, the engineered phenotype is generated by knocking out expression of a homologous gene. The gene's coding sequence or one or more transcriptional control elements can be knocked out, e.g., promoters or enhancers. Thus, the expression of a transcript can be completely ablated or only decreased.

In one aspect of the invention, the engineered phenotype comprises increasing the expression of a homologous gene. This can be effected by knocking out of a negative control element, including a transcriptional regulatory element acting in cis- or trans-, or, niutagenizing a positive control element. One or more, or, all the transcripts of a cell can be measured by hybridization of a sample comprising transcripts of the cell, or, nucleic acids representative of or complementary to transcripts of a cell, by hybridization to immobilized nucleic acids on an array.

Monitoring Expression of Apolypeptides, Peptides and Amino Acids

In one aspect of the invention, the engineered phenotype comprises increasing or decreasing the expression of a polypeptide (e.g., an ammonia lyase, e.g., phenylalanine ammonia lyase, tyrosine ammonia lyase and/or histidine ammonia lyase enzyme) or generating new polypeptides in a cell. This increased or decreased expression can be traced by determining the amount of ammonia lyase, e.g., phenylalanine ammonia lyase, tyrosine ammonia lyase and/or histidine ammonia lyase enzyme present or by ammonia lyase, e.g., phenylalanine ammonia lyase, tyrosine ammonia lyase and/or histidine ammonia lyase enzyme activity assays. Polypeptides, peptides and amino acids also can be detected and quantified by any method known in the art, including, e.g., nuclear magnetic resonance (NMR), spectrophotometry, radiography (protein radiolabeling), electrophoresis, capillary electrophoresis, high performance liquid chromatography (HPLC), thin layer chromatography (TLC), hyperdiffusion chromatography, various immunological methods, e.g. immunoprecipitation, immunodiffusion, immuno-electrophoresis, radioimmunoassays (RIAs), enzyme-linked immunosorbent assays (ELISAs), immuno-fluorescent assays, gel electrophoresis (e.g., SDS-PAGE), staining with antibodies, fluorescent activated cell sorter (FACS), pyrolysis mass spectrometry, Fourier-Transform Infrared Spectrometry, Raman spectrometry, GC-MS, and LC-Electrospray and cap-LC-tandem-electrospray mass spectrometries, and the like. Novel bioactivities can also be screened using methods, or variations thereof, described in U.S. Pat. No. 6,057,103. Furthermore, as discussed below in detail, one or more, or, all the polypeptides of a cell can be measured using a protein array.

Pharmaceutical Compositions and Dietary Supplements

The invention provides pharmaceutical compositions, e.g., formulations, comprising a composition (including polypeptide, nucleic acid, or antibody) of the invention and a pharmaceutically acceptable excipient. The invention provides enteral and parenteral formulations comprising compositions of the invention. For example, the invention provides oral formulations (including or dietary supplements) comprising a composition of the invention. The invention provides formulations and methods for treating/ameliorating phenylketonuria (PKU); e.g., in one aspect the invention provides methods comprising providing a pharmaceutical composition or dietary supplement comprising a composition of the invention; and administering an effective amount of the pharmaceutical composition or dietary supplement to a subject in need thereof, thereby/ameliorating phenylketonuria (PKU).

The invention provides methods for decreasing the levels of phenylalanine (Phe) in a fluid or liquid, e.g., in the bloodstream (hyperphenylalaninemia)—including bodily fluids such as cerebral spinal fluid (CSF) and the like. The method can also be practiced ex vivo or in vitro, or on a non-biological fluid or substance. In this aspect, the method comprises providing a pharmaceutical composition or dietary supplement comprising a formulation of the invention; and administering an effective amount of the pharmaceutical composition or dietary supplement to a subject in need thereof.

The pharmaceutical compositions and dietary supplements used in the methods of the invention can be administered by any means known in the art, e.g., parenterally, topically, orally, or by local administration, such as by aerosol or transdermally. The compositions and dietary supplements of the invention can be formulated as a tablet, gel, geltab, pill, implant, liquid, spray, powder, food, feed pellet, as an injectable formulation or as an encapsulated formulation. The pharmaceutical compositions and dietary supplements can be formulated in any way and can be administered in a variety of unit dosage forms depending upon the condition or disease and the degree of illness, the general medical condition of each patient, the resulting preferred method of administration and the like. Details on techniques for formulation and administration are well described in the scientific and patent literature, see, e.g., the latest edition of Remington's Pharmaceutical Sciences, Maack Publishing Co, Easton Pa. ("Remington's") (e.g., Remington, The Science and Practice of Pharmacy, 21st Edition, by University of the Sciences in Philadelphia, Editor).

Pharmaceutical formulations and dietary supplements can be prepared according to any method known to the art for the manufacture of pharmaceuticals and dietary supplements. Such drugs and dietary supplements can contain sweetening agents, flavoring agents, coloring agents and preserving agents. A formulation (which includes "dietary supplements") can be admixtured with nontoxic pharmaceutically or orally acceptable excipients which are suitable for manufacture. Formulations may comprise one or more diluents, emulsifiers, preservatives, buffers, excipients, etc. and may be provided in such forms as liquids, powders, emulsions, lyophilized powders, sprays, creams, lotions, controlled release formulations, tablets, pills, gels, on patches, in implants, etc.

Pharmaceutical formulations and dietary supplements for oral administration can be formulated using pharmaceutically acceptable carriers well known in the art in appropriate and suitable dosages. Such carriers enable the pharmaceuticals and dietary supplements to be formulated in unit dosage forms as tablets, pills, powder, dragees, capsules, liquids, lozenges, gels, syrups, slurries, suspensions, etc., suitable for ingestion by the patient. Pharmaceutical preparations and dietary supplements for oral use can be formulated as a solid excipient, optionally grinding a resulting mixture, and processing the mixture of granules, after adding suitable additional compounds, if desired, to obtain tablets or dragee cores. Suitable solid excipients are carbohydrate or protein fillers include, e.g., sugars, including lactose, sucrose, mannitol, or sorbitol; starch from corn, wheat, rice, potato, or other plants; cellulose such as methyl cellulose, hydroxypropylmethylcellulose, or sodium carboxy-methylcellulose; and gums including arabic and tragacanth; and proteins, e.g., gelatin and collagen. Disintegrating or solubilizing agents may be added, such as the cross-linked polyvinyl pyrrolidone, agar, alginic acid, or a salt thereof, such as sodium alginate.

Dragee cores are provided with suitable coatings such as concentrated sugar solutions, which may also contain gum arabic, talc, polyvinylpyrrolidone, carbopol gel, polyethylene glycol, and/or titanium dioxide, lacquer solutions, and suitable organic solvents or solvent mixtures. Dyestuffs or pigments may be added to the tablets or dragee coatings for product identification or to characterize the quantity of active compound (i.e., dosage). Pharmaceutical preparations and dietary supplements of the invention can also be used orally using, e.g., push-fit capsules made of gelatin, as well as soft, sealed capsules made of gelatin and a coating such as glycerol or sorbitol. Push-fit capsules can contain active agents mixed with a filler or binders such as lactose or starches, lubricants such as talc or magnesium stearate, and, optionally, stabilizers. In soft capsules, the active agents can be dissolved or suspended in suitable liquids, such as fatty oils, liquid paraffin, or liquid polyethylene glycol with or without stabilizers.

Aqueous suspensions can contain an active agent (e.g., a lyase polypeptide or peptidomimetic of the invention) in admixture with excipients suitable for the manufacture of aqueous suspensions. Such excipients include a suspending agent, such as sodium carboxymethylcellulose, methylcellulose, hydroxypropylmethylcellulose, sodium alginate, polyvinylpyrrolidone, gum tragacanth and gum acacia, and dispersing or wetting agents such as a naturally occurring phosphatide (e.g., lecithin), a condensation product of an alkylene oxide with a fatty acid (e.g., polyoxyethylene stearate), a condensation product of ethylene oxide with a long chain aliphatic alcohol (e.g., heptadecaethylene oxycetanol), a condensation product of ethylene oxide with a partial ester derived from a fatty acid and a hexitol (e.g., polyoxyethylene sorbitol mono-oleate), or a condensation product of ethylene oxide with a partial ester derived from fatty acid and a hexitol anhydride (e.g., polyoxyethylene sorbitan mono-oleate). The aqueous suspension can also contain one or more preservatives such as ethyl or n-propyl p-hydroxybenzoate, one or more coloring agents, one or more flavoring agents and one or more sweetening agents, such as sucrose, aspartame or saccharin. Formulations can be adjusted for osmolality.

Oil-based pharmaceuticals are particularly useful for administration of hydrophobic formulations or active agents of the invention. Oil-based suspensions can be formulated by suspending an active agent (e.g., a composition of the invention) in a vegetable oil, such as arachis oil, olive oil, sesame oil or coconut oil, or in a mineral oil such as liquid paraffin; or a mixture of these. See e.g., U.S. Pat. No. 5,716,928 describing using essential oils or essential oil components for increasing bioavailability and reducing inter- and intra-individual variability of orally administered hydrophobic pharmaceutical compounds (see also U.S. Pat. No. 5,858,401). The oil suspensions can contain a thickening agent, such as beeswax, hard paraffin or cetyl alcohol. Sweetening agents can be added to provide a palatable oral preparation, such as glycerol, sorbitol or sucrose. These formulations and dietary supplements can be preserved by the addition of an antioxidant such as ascorbic acid. As an example of an injectable oil vehicle, see Minto (1997) J. Pharmacol. Exp. Ther. 281:93-102.

The pharmaceutical formulations and dietary supplements of the invention can also be in the form of oil-in-water emulsions. The oily phase can be a vegetable oil or a mineral oil, described above, or a mixture of these. Suitable emulsifying agents include naturally-occurring gums, such as gum acacia and gum tragacanth, naturally occurring phosphatides, such as soybean lecithin, esters or partial esters derived from fatty acids and hexitol anhydrides, such as sorbitan mono-oleate, and condensation products of these partial esters with ethylene oxide, such as polyoxyethylene sorbitan mono-oleate. The emulsion can also contain sweetening agents and flavoring agents, as in the formulation of syrups and elixirs. Such formulations can also contain a demulcent, a preservative, or a coloring agent.

In the methods of the invention, the pharmaceutical compounds and dietary supplements can also be administered by in intranasal, intraocular and intravaginal routes including suppositories, insufflation, powders and aerosol formulations (for examples of steroid inhalants, see Rohatagi (1995) J. Clin. Pharmacol. 35:1 187-1 193; Tjwa (1995) Ann. Allergy Asthma Immunol. 75: 107-1 11). Suppositories formulations can be prepared by mixing the drug with a suitable non-irritating excipient which is solid at ordinary temperatures but liquid at body temperatures and will therefore melt in the body to release the drug. Such materials are cocoa butter and polyethylene glycols.

In the methods of the invention, the pharmaceutical compounds and dietary supplements can be delivered by transdermally, by a topical route, formulated as applicator sticks, solutions, suspensions, emulsions, gels, creams, ointments, pastes, jellies, paints, powders, and aerosols.

In the methods of the invention, the pharmaceutical compounds and dietary supplements can also be delivered as microspheres for slow release in the body. For example, microspheres can be administered via intradermal injection of drug which slowly release subcutaneously; see Rao (1995) J. Biomater Sci. Polym. Ed. 7:623-645; as biodegradable and injectable gel formulations, see, e.g., Gao (1995) Pharm. Res. 12:857-863 (1995); or, as microspheres for oral administration, see, e.g., Eyles (1997) J. Pharm. Pharmacol. 49:669-674.

In the methods of the invention, the pharmaceutical compounds can be parenterally administered, such as by intravenous (IV) administration or administration into a body cavity or lumen of an organ. These formulations can comprise a solution of active agent dissolved in a pharmaceutically acceptable carrier. Acceptable vehicles and solvents that can be employed are water and Ringer's solution, an isotonic sodium chloride. In addition, sterile fixed oils can be employed as a solvent or suspending medium. For this purpose any bland fixed oil can be employed including synthetic mono- or diglycerides. In addition, fatty acids such as oleic acid can likewise be used in the preparation of injectables.

These solutions are sterile and generally free of undesirable matter. These formulations may be sterilized by conventional, well known sterilization techniques. The formulations may contain pharmaceutically acceptable auxiliary substances as required to approximate physiological conditions such as pH adjusting and buffering agents, toxicity adjusting agents, e.g., sodium acetate, sodium chloride, potassium chloride, calcium chloride, sodium lactate and the like. The concentration of active agent in these formulations can vary widely, and will be selected primarily based on fluid volumes, viscosities, body weight, and the like, in accordance with the particular mode of administration selected and the patient's needs. For IV administration, the formulation can be a sterile injectable preparation, such as a sterile injectable aqueous or oleaginous suspension. This suspension can be formulated using those suitable dispersing or wetting agents and suspending agents. The sterile injectable preparation can also be a suspension in a nontoxic parenterally-acceptable diluent or solvent, such as a solution of 1,3-butanediol. The administration can be by bolus or continuous infusion (e.g., substantially uninterrupted introduction into a blood vessel for a specified period of time).

The pharmaceutical compounds, formulations and dietary supplements of the invention can be lyophilized. The invention provides a stable lyophilized formulation comprising a composition of the invention, which can be made by lyophilizing a solution comprising a pharmaceutical of the invention and a bulking agent, e.g., mannitol, trehalose, raffmose, and sucrose or mixtures thereof. A process for preparing a stable lyophilized formulation can include the equivalent of lyophilizing a solution about 2.5 mg/mL protein, about 15 mg/mL sucrose, about 19 mg/mL NaCl, and a sodium citrate buffer having a pH greater than 5.5 but less than 6.5. See, e.g., U.S. patent app. no. 20040028670.

The compositions (e.g., formulations, including dietary supplements) of the invention can be delivered by the use of liposomes. By using liposomes, particularly where the liposome surface carries ligands specific for target cells, or are otherwise preferentially directed to a specific organ, one can focus the delivery of the active agent into target cells in vivo. See, e.g., U.S. Pat. Nos. 6,063,400; 6,007,839; Al-Muhammed (1996) J. Microencapsul. 13:293-306; Chonn (1995) Curr. Opin. Biotechnol. 6:698-708; Ostro (1989) Am. J. Hosp. Pharm. 46:1576-1587.

The compositions (e.g., formulations, including dietary supplements) of the invention can be administered for prophylactic and/or therapeutic treatments. In therapeutic applications, compositions are administered to a subject already suffering from a condition, infection or disease (e.g., PKU) in an amount sufficient to cure, alleviate or partially arrest the clinical manifestations of the condition, infection or disease and its complications (a "therapeutically effective amount"). In the methods of the invention, a pharmaceutical composition is administered in an amount sufficient to treat (e.g., ameliorate) or prevent PKU-related conditions, diseases or symptoms, or to decrease the amount of phenylalanine in a body fluid such as blood, serum, CSF and the like. The amount of composition (e.g., pharmaceutical compositions, formulations, including dietary supplements) adequate to accomplish this is defined as a "therapeutically effective dose." The dosage schedule and amounts effective for this use, i.e., the "dosing regimen," will depend upon a variety of factors, including the stage of the disease or condition, the severity of the disease or condition, the general state of the patient's health, the patient's physical status, age and the like. In calculating the dosage regimen for a patient, the mode of administration also is taken into consideration.

The dosage regimen also takes into consideration pharmacokinetics parameters well known in the art, i.e., the active agents' rate of absorption, bioavailability, metabolism, clearance, and the like (see, e.g., Hidalgo-Aragones (1996) J. Steroid Biochem. Mol. Biol. 58:61 1-617; Groning (1996) Pharmazie 51:337-341; Fotherby (1996) Contraception 54:59-69; Johnson (1995) J. Pharm. Sci. 84:1 144-1 146; Rohatagi (1995) Pharmazie 50:610-613; Brophy (1983) Eur. J. Clin. Pharmacol. 24:103-108; the latest Remington's, supra). The state of the art allows the clinician to determine the dosage regimen for each individual patient, active agent and disease or condition treated. Guidelines provided for similar compositions used as pharmaceuticals can be used as guidance to determine the dosage regiment, i.e., dose schedule and dosage levels, administered practicing the methods of the invention are correct and appropriate.

Single or multiple administrations of compositions (e.g., pharmaceutical compositions, formulations, including dietary supplements) of the invention can be given depending on the dosage and frequency as required and tolerated by the patient. The compositions should provide a sufficient quantity of active agent to effectively treat, ameliorate or prevent PKU or other PKU-related conditions, diseases or symptoms. For example, an exemplary pharmaceutical formulation for oral administration of a protein of the invention is in a daily amount of between about 0.1 to 0.5 to about 20, 50, 100 or 1000 or more µg per kilogram of body weight per day. In an alternative embodiment, dosages are from about 1 mg to about 4 mg per kg of body weight per patient per day are used. Lower dosages can be used, in contrast to administration orally, into the blood stream, into a body cavity or into a lumen of an organ. Substantially higher dosages can be used in topical or oral administration or administering by powders, spray or inhalation. Actual methods for preparing parenterally or non-parenterally administrable formulations will be known or apparent to those skilled in the art and are described in more detail in such publications as Remington's, supra.

The compositions (e.g., pharmaceutical compositions, formulations, including dietary supplements) of the invention can further comprise other drugs or pharmaceuticals, e.g., compositions for treating PKU and related symptoms or conditions. The methods of the invention can further comprise co-administration with other drugs or pharmaceuticals, e.g., compositions for treating septic shock, infection, fever, pain and related symptoms or conditions. For example, the methods and/or compositions and formulations of the invention can be co-formulated with and/or co-administered with antibiotics (e.g., antibacterial or bacteriostatic peptides or proteins).

In one aspect, the polypeptide (e.g., including a pharmaceutical composition or dietary supplement) of the invention is chemically modified. For example, the polypeptide can be chemically modified to produce a protected form that possesses better specific activity, prolonged half-life, and/or reduced immunogenicity in vivo. A polypeptide of the invention can be modified by any means known in the art, for example, by glycosylation, pegylation or a combination thereof.

In one aspect, the polypeptide (e.g., including a pharmaceutical composition or dietary supplement) of the invention is formulated by encapsulation in a liposome, or a micro- or nano-structure, such as a nanotubule or a nano- or microcapsule.

In one aspect, the polypeptide is formulated in a matrix stabilized enzyme crystal. The invention also provides matrix stabilized enzyme crystals comprising a polypeptide of the invention for use as pharmaceutical composition or dietary supplement, e.g., to treat or ameliorate phenylketonuria (PKU), e.g., as described in U.S. Patent App. No. 20020182201; for example, the formulation can be a cross-linked crystalline enzyme and a polymer with a reactive moiety effective to adhere to the crystal layer of the crystalline enzyme. The invention also provides polypeptides of the invention as polymers in the form of multimerized (e.g., multi-functional) cross-linking forms; which in one aspect comprise a matrix stabilized enzyme crystal, e.g., a form resistant to degradation by proteolytic enzymes; and in alternative aspects, the cross-linking reagents comprise a dialdehyde cross-linking reagent, such as a linear or branched dialdehyde, or a substituted or unsubstituted glutaraldehyde (1,5-pentanedial), malonaldehyde (1,3-propanedial), succinaldehyde (1,4-butanedial), adipaldehyde (1,6-hexanedial), pimelaldehyde (1,7-heptanedial), or, glutaraldehyde; in otlier alternative aspects, the cross-linking reagents comprise carbodiimides, isoxazolium derivatives, chloroformates, carbonyldiimidazole, bis-imidoesters, bis-succinimidyl derivatives, di-isocyanates, di-isothiocyanates, di-sylfonyl halides, bis-nitrophenyl esters, dialdehydes, diacylazides, bis-maleimides, bis-haloacetyl derivatives, di-alkyl halides and bis-oxiranes (e.g., as described in U.S. Pat. No. 5,753,487).

The compositions of the invention can also be manufactured into biocompatible matrices, e.g., sol-gels, for encapsulating a polypeptide of the invention for use as pharmaceutical composition or dietary supplement, e.g., to treat or ameliorate phenylketonuria (PKU). In one aspect, compositions of the invention are manufactured as silica-based (e.g., oxysilane) sol-gel matrices, e.g., as described in U.S. Pat. No. 6,395,299, Pat. App. No. 20040241205. The invention also provides nano- or microcapsules comprising a composition of the invention for use as pharmaceutical composition or dietary supplement, e.g., to treat or ameliorate phenylketonuria (PKU), e.g., as described in U.S. Patent App. No. 20030157181.

The pharmaceutical compositions of the invention can be manufactured using any conventional method, e.g., mixing, dissolving, granulating, dragee-making, levigating, emulsifying, encapsulating, entrapping, melt-spinning, spray-drying, or lyophilizing processes. Alternative pharmaceutical formulations can be determined depending on the patient (e.g., adult or pediatric), condition (e.g., PKU), route of administration (e.g., oral) and the desired dosage.

Methods for determining levels of phenylalanine (Phe) in the bloodstream (hyperphenylalaninemia)—elevated or decreased levels—are well known in the art, and any can be used to practice the instant invention. For example, in one aspect, blood Phe levels are measured using an automated fiuorometric or a "Guthrie test" blood sample system; see, e.g., Kirkman (1982) Am. J. Hum. Genet. 34(5):743-752; or, Gerasimova (1989) Clinical Chemistry 35:21 12-2115, modified the method of McCaman and Robins for fiuorometry of phenylalanine to a microplate assay for routine phenylketonuria screening, and sensitivity is 15 m$\mu$ mol/L for a plasma assay and 30 m$\mu$ mol/L for a dried blood-spot assay.

Methods for diagnosing and managing PKU patients also are well known in the art, and any can be used to practice the instant invention. For example, compositions (e.g., pharmaceutical compositions, formulations, including dietary supplements) of the invention can be administered to ameliorate hyperphenylalaninemia blood phenylalanine levels exceeding the limits of the acceptable upper reference range of about 2 mg/dL or 120 mmol/L. Compositions (e.g., pharmaceutical compositions, formulations, including dietary supplements) of the invention can be administered to ameliorate the levels of blood phenylalanine found in patients with phenylketonuria (PKU), including phenylalanine levels exceeding about 20 mg/dL (1200 mmol/L), which are considered diagnostic for PKU. The compositions (e.g., pharmaceutical compositions, formulations, including dietary supplements) of the invention also can be used to ameliorate nonphenylketonuric hyperphenylalaninemia, which includes phenylalanine levels between about 2 mg/dL and about 20 mg/dL. Compositions (e.g., pharmaceutical compositions, formulations, including dietary supplements) of the invention can be administered to individuals with phenylalanine levels of about 6 mg/dL (360 mmol/L) or less in patients consuming an unrestricted diet as either an ameliorative or prophylactic treatment regimen. Administration of compositions of the invention can be in conjunction with dietary restrictions, e.g., indicated for patients whose phenylalanine levels are more than about 12 mg/dL (725 mmol/L); chronic phenylalanine levels in this range reportedly cause measurable intellectual impairment in children. Compositions (e.g., pharmaceutical compositions, formulations, including dietary supplements) of the invention can be administered to children with phenylalanine levels in the intermediate range of about 6.6 to 10 mg/dL (400-600 mmol/L) or about 7-1 1 mg/dL (425-660 mmol/L), e.g., 8-9 mg/dL (480-545 mmol/L), or 10 mg/dL (600 mmol/L). One study noted that most centers in the United States recommend restricting dietary phenylalanine when levels exceed 10 mg/dL (600 mmol/L). Many also recommend treatment for levels exceeding 8-9 mg/dL (480-545 mmol/L).

The British Medical Research Council Working Party on PKU recommends dietary phenylalanine (Phe) restriction when levels consistently exceed 6.6-10 mg/dL (400-600 mmol/L). The British policy for dietary treatment recommends that blood Phe levels in infants and young children be maintained between 2-6 mg/dL with relaxation of Phe levels after childhood. Thus, in one aspect, compositions (e.g., pharmaceutical compositions, formulations, including dietary supplements) of the invention can be administered to infants and young children having Phe levels over about 6 mg/dL, for Phe level maintenance between 2-6 mg/dL.

There is a strong relationship between increasing levels of Phe and abnormalities in the neonate. Reports have indicated that fetuses exposed to maternal Phe levels of 3-10 mg/dL had a 24 percent incidence of microcephaly, while those exposed to levels>20 mg/dL had a 73 percent incidence. Thus, in one aspect, compositions (e.g., pharmaceutical compositions, formulations, including dietary supplements) of the invention can be administered to pregnant women having maternal Phe levels of about 3-10 mg/dL. Similarly, congenital heart disease was not seen among offspring of women with Phe levels<10 mg/dL and 12 percent for levels>20 mg/dL. Recent data indicates that levels of Phe above 6 mg/dL during pregnancy are associated with significant linear decrements in the IQ of the child through 7 years of age.

In one aspect, PAL enzymes of the invention are orally administered; these enzymes are designed (e.g., by sequence, covalent or noncovalent modification, or by formulation) to have high activity and stability in gastric environment and retain activity in an enteric environment. PAL enzymes of the invention can be delivered via subcutaneous or via intravenous injection; these also are designed (e.g., by sequence, covalent or noncovalent modification, or by formulation) to have high activity levels at physiologically relevant pHs. In one aspect, enzymes of the invention (e.g., PAL enzymes) are designed and/or formulated as pharmaceutical products, e.g., for PKU or related conditions, e.g., any form of hyperphenylalaninemia; including being designed and/or formulated to have the appropriate activity ($k_{cat}/K_M$), pH optimum and/or gastric stability. Typically, PAL characterization is performed in two stages: I) Determination of kinetic parameters: $K_{cat}$, $K_M$, and, II) Stability in simulated gastric environment.

Applications—Industrial, Experimental, Food and Feed Processing

Polypeptides (including enzymes and antibodies) and nucleic acids of the invention can be used for a variety of industrial, experimental, food and feed processing, nutritional and pharmaceutical applications, e.g., for food and feed supplements, colorants, neutraceuticals, cosmetic and pharmaceutical needs (as discussed, above).

Polypeptides of the invention having lyase activity (e.g., having ammonia lyase, e.g., phenylalanine ammonia lyase (PAL), tyrosine ammonia lyase and/or histidine ammonia lyase activity) can catalyze the deamination of phenylalanine or tyrosine to trans-cinnamic acid and ammonia (FIG. 5). PALs catalyze the abstraction of ammonia from histidine to form urocanoic acid. The enzymes of the invention can be highly selective catalysts.

The invention provides methods using enzymes of the invention in the food and feed industries, e.g., in methods for making food and feed products and food and feed additives. In one aspect, the invention provides processes using enzymes of the invention in the medical industry, e.g., to make pharmaceuticals, neutraceuticals, food supplements and the like. In another aspect, the enzymes of the invention can be used in the manufacture of phenylalanine and tyrosine as well as phenylalanine and tyrosine derivatives. In alternative aspects, the enzymes of the invention can be used to degrade phenylalanine, tyrosine, and derivatives thereof to manufacture cinnamic acid, para-hydroxycinnamic acid and derivatives thereof. In yet another aspect, the enzymes of the invention can be used in the manufacture of bulk and fine chemicals for industrial, medicinal and agricultural use, as well as the direct application of the enzymes themselves; for example, enzymes (e.g., PALs) of the invention are used for enzyme substitution therapy for the treatment/amelioration of phenylketonuria (PKU), an inherited metabolic disease caused by a deficiency of the enzyme phenylalanine hydroxylase.

The enzymes of the invention can catalyze reactions with exquisite stereo-, regio- and chemo-selectivities. For example, enzymes of the invention, including ammonia lyases, e.g., phenylalanine ammonia lyase, tyrosine ammonia lyase and/or histidine ammonia lyase enzymes of the invention, can function (or be engineered to function) in various solvents, operate at extreme pHs (for example, high pHs and low pHs) extreme temperatures (for example, high temperatures and low temperatures), extreme salinity levels (for example, high salinity and low salinity) and catalyze reactions with compounds that are structurally unrelated to their natural, physiological substrates.

Animal Feeds and Food or Feed Additives

The invention provides methods for treating animals (individuals) feeds and foods and food or feed additives using enzymes of the invention, including ammonia lyases, e.g., phenylalanine ammonia lyase, tyrosine ammonia lyase and/ or histidine ammonia lyase enzymes of the invention, and/or the antibodies of the invention. The invention provides animal feeds, foods, and additives comprising ammonia lyase, e.g., phenylalanine ammonia lyase, tyrosine ammonia lyase and/ or histidine ammonia lyase enzymes of the invention and/or antibodies of the invention. The animal (individuals) can be a human, or any wild, farm or domestic animal, or any animal.

The animal feed, or human food, additive of the invention may be a granulated enzyme product that may readily be mixed with feed components. Alternatively, feed or human food additives of the invention can form a component of a pre-mix. The granulated enzyme product of the invention may be coated or uncoated. The particle size of the enzyme granulates can be compatible with that of feed and pre-mix components. This provides a safe and convenient mean of incorporating enzymes into feeds or human foods. Alternatively, the animal feed or human food additive of the invention may be a stabilized liquid composition. This may be an aqueous or oil-based slurry. See, e.g., U.S. Pat. No. 6,245,546.

Ammonia lyase, e.g., phenylalanine ammonia lyase, tyrosine ammonia lyase and/or histidine ammonia lyase enzymes of the present invention, in the modification of animal feed or a food, can process the food or feed either in vitro (by modifying components of the feed or food) or in vivo. Polypeptides of the invention can be added to animal feed or food compositions (which include food, e.g., dietary, supplements).

In one aspect, an enzyme of the invention is added in combination with another enzyme, e.g., beta-galactosidases, catalases, laccases, cellulases, endoglycosidases, endo-beta-1,4-laccases, amyloglucosidases, glucose isomerases, glycosyltransferases, lipases, phospholipases, lipooxygenases, beta-laccases, endo-beta-1,3(4)-laccases, cutinases, peroxidases, amylases, glucoamylases, pectinases, reductases, oxidases, decarboxylases, phenoloxidases, ligninases, pullulanases, arabinanases, hemicellulases, mannanases, xylolaccases, xylanases, pectin acetyl esterases, rhamnogalacturonan acetyl esterases, proteases, peptidases, proteinases, polygalacturonases, rhamnogalacturonases, galactanases, pectin lyases, transglutaminases, pectin methylesterases, cellobiohydrolases and/or transglutaminases. These enzyme digestion products are more digestible by the human or animal. Thus, ammonia lyase, e.g., phenylalanine ammonia lyase, tyrosine ammonia lyase and/or histidine ammonia lyase enzymes of the invention can contribute to the available energy of the feed or food.

In another aspect, ammonia lyase, e.g., phenylalanine ammonia lyase, tyrosine ammonia lyase and/or histidine ammonia lyase enzyme of the invention can be supplied by expressing the enzymes directly in transgenic feed crops (as, e.g., transgenic plants, seeds and the like), such as grains, cereals, corn, soy bean, rape seed, lupin and the like, or human foods. As discussed above, the invention provides transgenic plants, plant parts and plant cells comprising a nucleic acid sequence encoding a polypeptide of the invention. In one aspect, the nucleic acid is expressed such that the ammonia lyase, e.g., phenylalanine ammonia lyase, tyrosine ammonia lyase and/or histidine ammonia lyase enzyme of the invention is produced in recoverable quantities. The ammonia lyase, e.g., phenylalanine ammonia lyase, tyrosine ammonia lyase and/or histidine ammonia lyase enzyme can be recovered from any plant or plant part. Alternatively, the plant or plant part containing the recombinant polypeptide can be used as such for improving the quality of a food or feed, e.g., improving nutritional value, palatability, etc.

The enzyme delivery matrix of the invention is in the form of discrete plural particles, pellets or granules. By "granules" is meant particles that are compressed or compacted, such as by a pelletizing, extrusion, or similar compacting to remove water from the matrix. Such compression or compacting of the particles also promotes intraparticle cohesion of the particles. For example, the granules can be prepared by pelletizing the grain-based substrate in a pellet mill. The pellets prepared thereby are ground or crumbled to a granule size suitable for use as an adjuvant in animal feed or human food. Since the matrix is itself approved for use in human or animal food or feed, it can be used as a diluent for delivery of enzymes in human or animal food or feed.

The ammonia lyase, e.g., phenylalanine ammonia lyase, tyrosine ammonia lyase and/or histidine ammonia lyase enzyme contained in the invention enzyme delivery matrix and methods is in one aspect a thermostable ammonia lyase, e.g., phenylalanine ammonia lyase, tyrosine ammonia lyase and/or histidine ammonia lyase enzyme, as described herein, so as to resist inactivation of the ammonia lyase, e.g., phenylalanine ammonia lyase, tyrosine ammonia lyase and/or histidine ammonia lyase enzyme during manufacture where elevated temperatures and/or steam may be employed to prepare the palletized enzyme delivery matrix. During digestion of feed or food containing the invention enzyme delivery matrix, aqueous digestive fluids will cause release of the active enzyme. Other types of thermostable enzymes and nutritional supplements that are thermostable can also be incorporated in the delivery matrix for release under any type of aqueous conditions.

A coating can be applied to the invention enzyme matrix particles for many different purposes, such as to add a flavor or nutrition supplement to animal feed or food, to delay release of animal feed or food supplements and enzymes in gastric conditions, and the like. Or, the coating may be applied to achieve a functional goal, for example, whenever it is desirable to slow release of the enzyme from the matrix particles or to control the conditions under which the enzyme will be released. The composition of the coating material can be such that it is selectively broken down by an agent to which it is susceptible (such as heat, acid or base, enzymes or other chemicals). Alternatively, two or more coatings susceptible to different such breakdown agents may be consecutively applied to the matrix particles.

The invention is also directed towards a process for preparing an enzyme-releasing matrix. In accordance with the invention, the process comprises providing discrete plural particles of a grain-based substrate in a particle size suitable for use as an enzyme-releasing matrix, wherein the particles comprise an ammonia lyase, e.g., phenylalanine ammonia lyase, tyrosine ammonia lyase and/or histidine ammonia lyase enzyme encoded by an amino acid sequence of the invention.

In one aspect, the process includes compacting or compressing the particles of enzyme-releasing matrix into granules, which most in one aspect is accomplished by pelletizing. The mold inhibitor and cohesiveness agent, when used, can be added at any suitable time, and in one aspect are mixed with the grain-based substrate in the desired proportions prior to pelletizing of the grain-based substrate. Moisture content in the pellet mill feed in one aspect is in the ranges set forth above with respect to the moisture content in the finished product, and in one aspect is about 14-15%. In one aspect, moisture is added to the feedstock in the form of an aqueous preparation of the enzyme to bring the feedstock to this moisture content. The temperature in the pellet mill in one aspect is brought to about 82° C. with steam. The pellet mill may be operated under any conditions that impart sufficient work to the feedstock to provide pellets. The pelleting process itself is a cost-effective process for removing water from the enzyme-containing composition.

The compositions and methods of the invention can be practiced in conjunction with administration of prebiotics, which are high molecular weight sugars, e.g., fructo-oligosaccharides (FOS); galacto-oligosaccharides (GOS), GRAS (Generally Recognized As Safe) material. These prebiotics can be metabolized by some probiotic lactic acid bacteria (LAB). They are non-digestible by the majority of intestinal microbes.

Treating Foods and Food Processing

The ammonia lyase, e.g., phenylalanine ammonia lyase, tyrosine ammonia lyase and/or histidine ammonia lyase enzymes of the invention have numerous applications in food processing industry. The invention provides methods for hydrolyzing phenylalanine, histidine and/or tyrosine-comprising compositions, including, e.g., a plant cell, a bacterial cell, a yeast cell, an insect cell, or an animal cell, or any plant or plant part, or any food or feed, a waste product and the like.

The invention provides feeds or foods comprising an ammonia lyase, e.g., phenylalanine ammonia lyase, tyrosine ammonia lyase and/or histidine ammonia lyase enzyme the invention, e.g., a feed, a liquid, e.g., a beverage (such as a fruit juice or a beer), a bread or a dough or a bread product, or a beverage precursor (e.g., a wort).

The food treatment processes of the invention can also include the use of any combination of other enzymes such as tryptophanases or tyrosine decarboxylases, laccases, catalases, laccases, cellulases, endoglycosidases, endo-beta-1,4-laccases, amyloglucosidases, glucose isomerases, glycosyltransferases, lipases, phospholipases, lipooxygenases, beta-laccases, endo-beta-1,3(4)-laccases, cutinases, peroxidases, amylases, glucoamylases, pectinases, reductases, oxidases, decarboxylases, phenoloxidases, ligninases, pullulanases, arabinanases, hemicellulases, mannanases, xylolaccases, xylanases, pectin acetyl esterases, rhamnogalacturonan acetyl esterases, proteases, peptidases, proteinases, polygalacturonases, rhamnogalacturonases, galactanases, pectin lyases, transglutaminases, pectin methylesterases, cellobiohydrolases and/or transglutaminases.

Waste Treatment

Enzymes of the invention, e.g., ammonia lyase, such as phenylalanine ammonia lyase, tyrosine ammonia lyase and/or histidine ammonia lyase enzymes of the invention can be used in a variety of other industrial applications, e.g., in waste treatment (in addition to, e.g., biomass conversion to fuels). For example, in one aspect, the invention provides a solid waste digestion process using ammonia lyase, e.g., phenylalanine ammonia lyase, tyrosine ammonia lyase and/or histidine ammonia lyase enzymes of the invention. The methods can comprise reducing the mass and volume of substantially untreated solid waste. Solid waste can be treated with an enzymatic digestive process in the presence of an enzymatic solution (including ammonia lyase, e.g., phenylalanine ammonia lyase, tyrosine ammonia lyase and/or histidine ammonia lyase enzymes of the invention) at a controlled temperature. This results in a reaction without appreciable bacterial fermentation from added microorganisms. The solid waste is converted into a liquefied waste and any residual solid waste. The resulting liquefied waste can be separated from said any residual solidified waste. See e.g., U.S. Pat. No. 5,709,796.

In one aspect, the compositions and methods of the invention are used for odor removal or odor reduction in animal waste lagoons, e.g., on swine farms, and other animal waste management systems.

The waste treatment processes of the invention can include the use of any combination of other enzymes, including other lyases, e.g., phenylalanine ammonia lyase, tyrosine ammonia lyase and/or histidine ammonia lyase enzymes, and also catalases, laccases, cellulases, endoglycosidases, endo-beta-1,4-laccases, amyloglucosidases, glucose isomerases, glycosyltransferases, lipases, phospholipases, lipooxygenases, beta-laccases, endo-beta-1,3(4)-laccases, cutinases, peroxidases, amylases, glucoamylases, pectinases, reductases, oxidases, decarboxylases, phenoloxidases, ligninases, pullulanases, phytases, arabinanases, hemicellulases, mannanases, xylolaccases, xylanases, pectin acetyl esterases, rhamnogalacturonan acetyl esterases, proteases, peptidases, proteinases, polygalacturonases, rhamnogalacturonases, galactanases, pectin lyases, transglutaminases, pectin methylesterases, cellobiohydrolases and/or transglutaminases.

Pharmaceutical Compositions and Dietary Supplements

The invention also provides pharmaceutical compositions and dietary supplements (e.g., dietary aids) comprising a cellulase of the invention (e.g., enzymes having endoglucanase, cellobiohydrolase, mannanase and/or beta-glucosidase activity). The cellulase activity comprises endoglucanase, cellobiohydrolase, mannanase and/or beta-glucosidase activity. In one aspect, the pharmaceutical compositions and dietary supplements (e.g., dietary aids) are formulated for oral ingestion, e.g., to improve the digestibility of foods and feeds having a high cellulose or lignocellulosic component.

Periodontal treatment compounds can comprise an enzyme of the invention, e.g., as described in U.S. Pat. No. 6,776,979. Compositions and methods for the treatment or prophylaxis of acidic gut syndrome can comprise an enzyme of the invention, e.g., as described in U.S. Pat. No. 6,468,964.

In another aspect, wound dressings, implants and the like comprise antimicrobial (e.g., antibiotic-acting) enzymes, including an enzyme of the invention (including, e.g., exemplary sequences of the invention). Enzymes of the invention can also be used in alginate dressings, antimicrobial barrier dressings, burn dressings, compression bandages, diagnostic tools, gel dressings, hydro-selective dressings, hydrocellular (foam) dressings, hydrocolloid dressings, I.V dressings, incise drapes, low adherent dressings, odor absorbing dressings, paste bandages, post operative dressings, scar management, skin care, transparent film dressings and/or wound closure. Enzymes of the invention can be used in wound cleansing, wound bed preparation, to treat pressure ulcers, leg ulcers, burns, diabetic foot ulcers, scars, IV fixation, surgical wounds and minor wounds. Enzymes of the invention can be used to in sterile enzymatic debriding compositions, e.g., ointments. In various aspects, the cellulase is formulated as a tablet, gel, pill, implant, liquid, spray, powder, food, feed pellet or as an encapsulated formulation.

Biodefense Applications

In other aspects, cellulases of the invention (e.g., enzymes having endoglucanase, cellobiohydrolase, mannanase and/or beta-glucosidase activity) can be used in biodefense (e.g., destruction of spores or bacteria comprising a lignocellulosic material). Use of cellulases of the invention in biodefense applications offer a significant benefit, in that they can be very rapidly developed against any currently unknown or biological warfare agents of the future. In addition, cellulases of the invention can be used for decontamination of affected environments. In aspect, the invention provides a biodefense or bio-detoxifying agent comprising a polypeptide having a cellulase activity, wherein the polypeptide comprises a sequence of the invention (including, e.g., exemplary sequences of the invention), or a polypeptide encoded by a nucleic acid of the invention (including, e.g., exemplary sequences of the invention), wherein optionally the polypeptide has activity comprising endoglucanase, cellobiohydrolase, mannanase and/or beta-glucosidase activity.

The following examples are offered to illustrate, but not to limit the claimed invention.

EXAMPLES

Example 1

Exemplary Histidine Ammonia Lyase (HAL) Screening Assay

HAL enzyme activity can be determined as described in Baedeker & Schulz (Eur. J. Biochem 2002, 269, 1790-1797), wherein enzyme activity was determined as the rate of urocanate formation, measured spectrophotometrically at 277 nm. For a standard assay, the enzyme was preincubated at 25° C. for 5 min in 2.5 mL buffer containing 0.1 M pyrophosphate (pH 9.3), 10 μM ZnC12 and 2 mM glutathione. The reaction was started by adding 200 μL of 0.5 M histidine solution and then monitored for approximately 5 minutes.

Example 2

Exemplary Phenylalanine Ammonia Lyase (PAL) Screening Assays

In one aspect, PAL enzyme activity can be determined as described in Rother & Retey (Eur. J. Biochem, 2002, 269, 3065-3075), by following the formation of E-cinnamate spectrophotometrically at 30° C. at 290 nm Specifically, the enzyme was preincubated at 30° C. for 5 min in 750 μL of 0.1 M Tris/HCl pH 8.8. The reaction was performed in 1-cm quartz cuvettes and was started by adding 250 μL of a 20-mM L-phenylalanine solution. Starting enzyme concentrations varied between 10 and 20 μg for active enzymes and between 0.3 and 0.4 mg for less active enzymes. Enzyme activity was measured every minute for 5 minutes for more active enzymes and every 5 minutes for 20 minutes for less active enzymes. For determination of kinetic constants, Km and Vmax, L-phenylalanine concentrations were varied from 0.01 to 5 mM. Kinetic constants were determined using a double reciprocal plot. The isolated enzymes were electrophoretically pure as verified by Coomassie Brilliant Blue R250 staining, allowing for the measurement of turnover numbers (kcat), using 311.313 as the molecular mass of tetrameric PAL.

In another aspect, PAL enzyme activity can be determined as described in Kyndt et al. (FEBS Letters 2002, 512, 240-24), by following cinnamic acid formation at 280 nm using a double beam spectrophotometer in 10 mM Tris buffer at 35° C.

Example 3

Exemplary Tyrosine Ammonia Lyase TTAL) Screening Assay

TAL enzyme activity can be determined as described in Kyndt et al. (FEBS Letters 2002, 512, 240-24), by monitoring p-hydroxycinnamic acid formation at 310 nm at 35° C.

Example 4

Exemplary Enzyme Discovery Protocols

This example describes some exemplary protocols for discovering and characterizing polypeptides.

Phase I: Survey of strain collections, enzymes. Unique Pal enzyme sequences are subcloned into a standard expression vector and targeted for expression in E. coli. The enzymes may be expressed with a C-terminal His tag to facilitate purification. Functional tagged clones can be over-expressed on 1 L shake flask scale and targeted for purification. Any clones not active as C-terminal His tag form can be evaluated in untagged form. Functional (untagged) clones can be over-expressed on 1 L shake flask scale. Due to the high volume of enzymes being evaluated, any clones that do not illustrate functional expression can be suspended from further analysis. Expressed, active clones can be purified at 50% to 85% homogeneity. Purified enzymes can be characterized as follows:

I. Kinetic Characterization: pH 7.4, 37° C.
Specific Activity (SA U/mg)
Estimate of $K_{031}ZKM$
Enzyme with (SA) and/or $K_{081}ZKM$ numbers higher than those for R. toruloides will be further characterized with respect to K-at and KM individually.
II. Stability Characterization
Performed under simulated gastric fluid (SGF) environment.
Residual activity (% SA) will be measured after treatment to SGF for various times.
Phase I Deliverables: (a) Kinetic characterization of enzymes ($K_{cat}$, KM), (b) Stability characterization of enzymes in SGF. (c) Prioritization of enzymes, partial purification, further evaluation.

Phase I can entail, cloning, over-expression, purification and characterization of PAL enzymes. Due to the high throughput nature of this work any enzymes that do not express well or that are recalcitrant to purification can be suspended from further analysis.

Should a property of an enzyme be found to be suboptimal during Phase I, enhancement of the required property through evolution of the enzyme(s) can be considered. DIRECTEVO-LUTION® optimization (as described above, and e.g., in U.S. Pat. No. 6,939,689) may be performed. In some aspects, high throughput assay for screening of the mutants is used. One of the numerous diagnostic assays available to Phe may be applicable. Alternately, an electrospray mass spectrometry (ESMS) assay (see, e.g., Mann, et al. (July 2001) Annual Review of Biochemistry, Vol. 70: 437-473) may be appropriate. Protein libraries screens for enhanced functionality can also be used.

Example 5

Exemplary Biocatalytic Production of pαm-Hydroxycinnamate

This example describes some exemplary protocols for the biocatalytic production of parø-hydroxycinnamate using enzymes of the invention. The invention provides polypeptides having tyrosine ammonia lyase (TAL) activity (e.g., enzymes) for the efficient synthesis of parø-hydroxycinnamate from L-tyrosine:

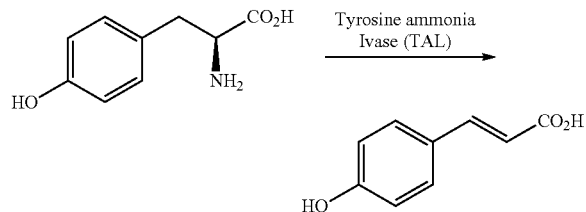

The invention provides industrial processes for synthesizing ^-hydroxy cinnamate (pHCA) from tyrosine, catalyzed by a TAL of the invention, as shown above. In one aspect, a TAL enzyme of the invention has a pH optimum around (about) pH 8, 9, 10, 11 or more alkaline; and in alternative aspects has different catalytic parameters:

| pH | $K_M$ (µM) | $K_i$ (µM) | $V_{max}$ (nmol/min/mg) |
|---|---|---|---|
| 7 | 500 | 20 | 120 |
| 8 | 300 | 60 | 780 |
| 9 | 300 | 700 | 810 |
| 10 | 1500 | 1300 | 1600 |

In one aspect, to make the process cost-effective, the protocol reaction is maintained pH at 7. In some situations there is a relatively high level of product inhibition which increases at lower pH values. Enzymes of the invention with relatively high catalytic efficiencies of the TAL reaction at pH 7 can be used, these enzymes are less susceptible to product inhibition. In one aspect, enzymes of the invention capable of achieving a desired process target of about ≥85% conversion at pH 7 with substrate loading of 50-100 g/L are used. Enzymes can be characterized in terms of their expression and specific activity. Newly discovered or developed (e.g., engineering a sequence of the invention with DIRECTEVOLUTION® optimization) TAL genes are cloned, expressed, and characterized. A wide variety of bacterial genes with TAL activity can be identified by screening environmental libraries with nucleic acids or antibodies of the invention.

Exemplary Discovery Strategies: Two Parallel Approaches to Enzyme, e.g., PAL or TAL Discovery can be Taken:
1. Sequence-based discovery of new enzymes, e.g., PALs or TALs: degenerate primers of the invention can be used to probe environmental DNA libraries. Sequence-based discovery tools that permit selective discovery of PALs or TALs over other ammonia lyases are used.
2. Activity-based discovery of new TALs: a mass spectrometry assay can be used to screen environmental DNA library clones. In one aspect, an MS TAL assay having a throughput of approximately 8000/week is used. In order to maximize the effectiveness of this screen, environmental library clones can be multiplexed.

Assay Development As described above, two discovery approaches can be used. For the sequence-based approach, sets of degenerate primers are synthesized and tested. Any methods for capturing full length genes can be used. For the activity-based screening approach, an MS assay (e.g., DuPont) is integrated into an optimal screening work-flow compatible with screening systems of the invention. Given the limited throughput of the MS assay, clones can be multiplexed, e.g., at 5-10 clones per well, increasing the throughput to approximately 80,000 assays per week. A secondary MS assay can be used to break out hits from the primary screen. Note that results from the sequence-based approaches can be used to cherry pick libraries for the activity screen.

Screening of DNA Libraries: Environmental DNA libraries from multiple sources and different environments can be screened for TAL activities. When hits are obtained the genes can be subcloned into appropriate expression vectors and the recombinant enzymes characterized. The activity and expression level of TALs can be determined using assays as described herein.

Exemplary PAL Discovery Protocol: Sequence-Based Approaches

PALs were confirmed to be active on o-Br-Phe using predictive bioinformatics to developed and/or distinguish PALs from HALs at the sequence level; this has been tested and confirmed experimentally on ammonia lyase genes. Using this approach, PALs of the invention have been identified and demonstrated to be active on o-Bromo Phe, as summarized in Table 2 (FIG. 9). Assay conditions: substrate conc.=2 mM, pH=8.5, Temp.=30° C. Express activities as units/mL of lysate; activities need not be normalized for expression.

Figure 10:
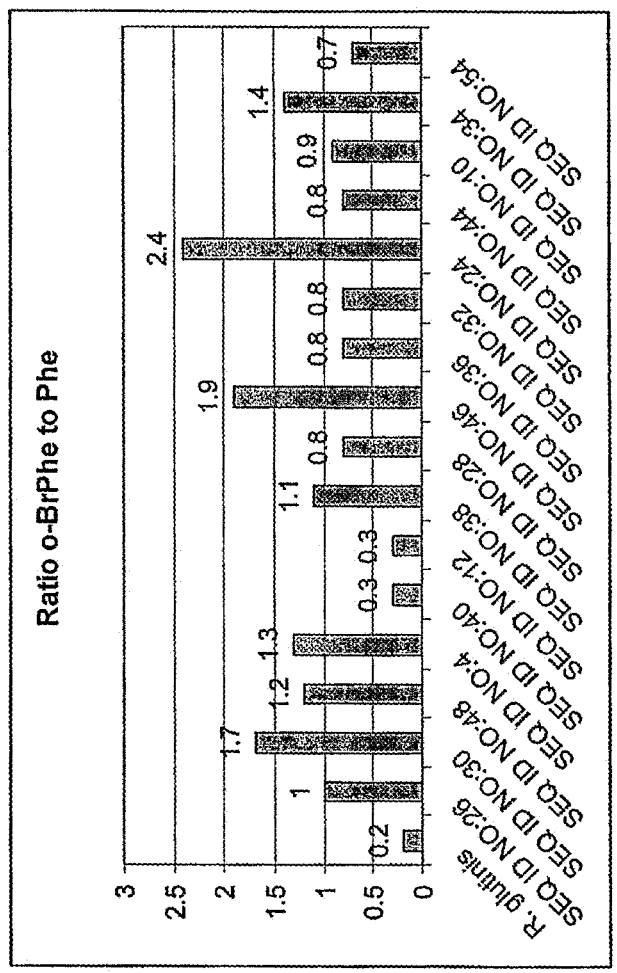
FIG. 10 is an illustration of a chart summarizing data of the ratio of activities of exemplary enzymes of the invention on o-BrPhe to Phe, as discussed in detail in Example 5, below.

16 out of 18 of the PALs in Table 2 (FIG. 9) are from bacterial species whose genomes have been sequenced and are publicly available. In these cases the ammonia lyase genes were annotated as HALs whereas we have shown them to be PALs. FIG. 10 shows the ratio of activities on o-BrPhe to Phe; as is evident from the table, most of the PALs have higher ratios (o-BrPhe to Phe) than the PAL from *R. glutinis*.

Figure 11:
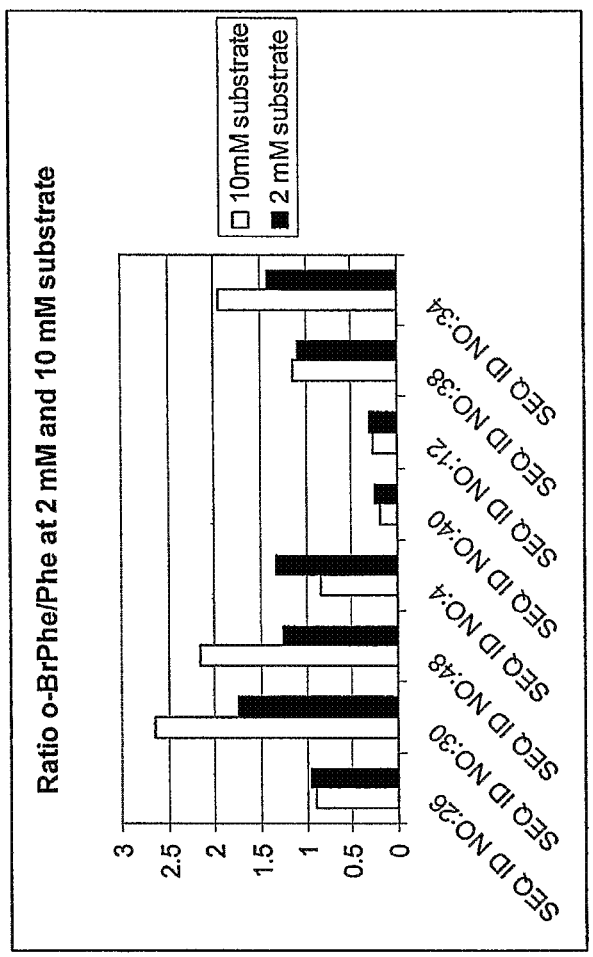
FIG. 11 is an illustration of a chart summarizing activity data for a subset of PALs, in particular, the effect of substrate concentration on the o-BrPhe to Phe activity ratio, as discussed in detail in Example 5, below.

For a subset of PALs, the effect of substrate concentration on the o-BrPhe to Phe activity ratio was investigated, as illustrated in FIG. 11. For many enzymes the ratio increased with increased substrate. This may be due to a higher Km for o-BrPhe and may be beneficial under some exemplary synthetic process conditions.

An exemplary activity-based discovery protocol comprises use of an ammonia selection using α-methylPhe to screen environmental libraries. Using this particular assay, PALs do not appear to be active on α-methylPhe. A phenylalanine selection screen was also implemented to screen libraries, e.g., environmental libraries—which yielded, inter alia, chorismate mutases (CM), which complement a PheA mutation in the auxotroph screening host. An adamantyl phosphonate, an inhibitor of CM activity, also was used to determine whether can minimize background CM activity in this selection/screening protocol. This inhibitor was found not be suitable because of lack of potency.

In round of screening, colonies were isolated that grew on α-methylPhe and α-methylTyr. Isolates were frozen as glycerol stocks; then grown on carbon-based medium supplemented with 5 mM α-methyl phenylalanine as sole nitrogen source. LC/MS analysis of cell-free extract activities of these isolates on α-methyl phenylalanine indicates no formation of cinnamic acid derivatives.

In summary, using a bioinformatics-driven approach, a sequence-based PAL discovery technology was used to probe environmental DNA libraries for the presence of new PALs. In summary sequence-based discovery of new PALs produced leads that showed activity on ortho-bromo phenylalanine.

Example 6

Exemplary Phenylalanine Ammonia Lyases

This example describes the screening and characterization of exemplary phenylalanine ammonia lyases of the invention for the synthesis of ortho-halo phenylalanine derivatives in high yield and high ee. In one aspect, the invention provides a selection and a screen for use in the discovery of PALs from libraries, e.g., environmental DNA libraries.

High Throughput Assay Development:
Ammonia selection:
  Used clone of *Rhodotorula glutinis* PAL in pUC57 vector, DH5α host.
  Phe, 2-ChloroPhe, and 2-BromoPhe all give background growth with negative control (host+empty vector). α-methylPhe gives no background growth.
  Positive control (host+*Rhodotorula* PAL) not active on α-methylPhe.
  New positive control (host+SEQ ID NO:52 (encoded by, e.g., SEQ ID NO:51)) is active on α-methylPhe.
  Environmental libraries are screened using α-methyl selection approach, including actinomycete PAC libraries and streptomycete small insert libraries.
Phenylalanine selection:
  Complementary to ammonia selection and does not require substrate analog,
  Obtained auxotrophic strain from ATCC.
  Strain is able to grow in presence of up to 25 mM cinnamic acid and up to 50 mM ammonium ion (pH dependent) on minimal media+phenylalanine. Therefore cinnamic acid and ammonia not toxic at these levels.
  Made competent cells and transformed with PAL vector to generate a positive control for selection development.
  Proof-of-principle experiments for Phe selection in progress using Phe auxotroph and positive control. Investigating growth with cinnamic acid and ammonium ion in absence of Phe.
  Strain development for library-compatible host.
High throughput fluorogenic assay:
  Developed fluorogenic assay based on fluorescence of orł/zo-hydroxycinnamic acid at high pH.
  SEQ ID NO:52 (encoded, e.g., by SEQ ID NO:51) and *R. glutinis* PALs show no activity on o/•t/b-hydroxyphenylalanine.
Analytical Assays
Non-chiral methods
  LC/MS assay:
    Developed one-minute LC-MS methods for the following substrate/product pairs:
      Cinnamic acid and phenylalanine;
      2-bromocinnamic acid and 2-bromophenylalanine;
      α-methyl cinnamic acid and α-methylphenylalanine.
    This medium throughput assay can be used for screening, e.g., evolution libraries
  Spectrophotometric assay: implemented continuous spectroscopic assay based on absorbance of cinnamic acid (or derivatives) at 290 nm.
    Tested the following substrates: L-Phenylalanine, 2-Chloro-L-phenylalanine, 2-Bromo-L-phenylalanine, α-Methyl-DL-phenylalanine, α-Methyl-L-phenylalanine.
Chiral method
  Developed chiral HPLC method to separate L-2-bromophenylalanine from D-2-bromophenylalanine
New PAL discovery
Sequence-based discovery
  bacterial PAL clone SEQ ID NO:52 (encoded by SEQ ID NO:51) subcloned into *E. coli* expression vector.
  PAL activity on phenylalanine confirmed.
    In contrast to *R. glutinis* PAL, PAL SEQ ID NO:52 shown to have activity on α-methylphenylalanine.
    PAL SEQ ID NO:52 also shown to have activity on 2-bromoPhe; ratio of 2-bromoPhe activity to Phe activity appears to be higher for SEQ ID NO:52 vs *R. glutinis* PAL.
  additional bacterial PALs can be identified by sequence homology and subcloned.
  fungal PALs can be identified and cloned from cDNA: sources include *Botrytis* sp., *Fusarium* sp.
  enzymes of the invention can be expressed in fungi or bacteria, e.g., in E. coli, *Cochliobolus heterotrophus*, and/or *Pichia pastoṇs*.
Activity-Based Discovery:
  an ammonia selection screening process using α-methylPhe or bromoPhe under process conditions can be used to screen environmental libraries.

Phe auxotroph-based selection can also be used to identify PALs.

Summary: The invention provides methods and compositions for discovering new lyases, e.g., PALs, using nucleic acids (e.g., probes) and polypeptides (e.g., antibodies) of the invention. In exemplary protocols described herein, several PAL discovery strategies were pursued in parallel; in one aspect, environmental libraries were screened using the ammonia-based selection and α-methylphenylalanine. In another aspect, a complementary selection strategy based on a phenylalanine auxotroph is used. In another aspect, a sequence-based method is used. In one exemplary protocol, when a new putative PAL is identified, e.g., in a library by sequence homology, it is cloned, expressed, and tested for enzyme activity (e.g., PAL activity).

A number of aspects of the invention have been described. Nevertheless, it will be understood that various modifications may be made without departing from the spirit and scope of the invention. Accordingly, other aspects are within the scope of the following claims.

SEQUENCE LISTING (252 sequences)

SEQ ID NO: 1 - DNA, 1548 bp, Tannerella forsythensis ATCC 43037
atggaaaaaaccgttacgtatcaatcagagaagggtttttcaatacacgacgtggagagactgctgttggggcagagtcatctaaaactatccgcagaatcgttgcaaaaagtagaacgttgcttcatttttttacgtgaattttcgaccgacaaagtgatctacggcatcaataccggtttcggtccgatggcgcaatatcgcgtggacgacaattgtctgaaacaactgcaatacaatattatccgaagccattcgacaggagccggcgaaccattggatccgatctacgtgaaagcggctatgatcgcaagattatcaacctttttacaaggttattccggcatacatacagacctcgtgcgattgctgaccgagtttatcaaccgcgacatctgcccgttcatccccgaacacgggagtgtaggagcaagtggcgaccttgtgcagttggcacatattgccctgaccctgatcggagaaggtgaagttttctacgaaggcaagcgccggccaacggccgaagtgatgcagaaagagaaactctctcccctcgatatttacattcgggaggggttgtcggccacgaacggcacctcggtcatgacggggatcggactggtgaacctgatttacgccaagaggctgctacattggtcgatcgccgcttcggtgatgatgaatgagatcgcatcatcatacgatgacctgatgtcgcccggactgaatgcgacgaagcgacacgaggggcagcaggagatagcacgtgcaatgtgccggtgggcggccgggagcaaagcgatgcgtaaacgcgagatcgaaatgtttcaacggcataccgagaaagtattcggacacaaggtacaggcttactattcgcttcgttgcgtgccgcaaatattaggtccgatatgggatacgatggcctacgcagagaaggtgctcgtcgatgaactgaactcagcttgtgacaacccgatcgtagatccggaggcgcaatacgtctatcacggaggcaacttccacggcgattatatttcgttcgaaatggataagttaaaaattgccgtgaccaaaatgacgatgctggcggagcgacaactcaactacctgtttcataatcgaattaacgacgatattttgccgccgttcgtgaatctcggcgtactgggactcaactacggcctgcaagctgcacaattcacggccacctcgacaacggccgagtgccagacgctctcgaacccgatgtacatccacagcatcccgaacaacaacgataatcaagacattgtaagcatgggtgccaatgcagccttgatggctaaaacggttattgagaacggctatcaggtaatggccatccattttatggcgcttgtgcaagccgtcgactacctgaaactgcaaccgcggatggcggagaagacacgcgctgtctacgacgaaatccgtgcgttctttccggtctttacggacgacacgccgaaataccgggagatcgaaacaatgattacttatttaaaatcttcaggaaaaagaatataa

SEQ ID NO: 2 - protein, 515 aa, Tannerella forsythensis ATCC 43037
  DOMAIN (4)...(493): Phenylalanine and histidine ammonia-lyase
MEKTVTYQSEKGFSIHDVERLLLGQSHLKLSAESLQKVERCFIFLREFSTDKVIYGINTGFGPMAQYRVDDNCLKQLQYNIIRSHSTGAGEPLDPIYVKAAMIARLSTFLQGYSGIHTDLVRLLTEFINRDICPFIPEHGSVGASGDLVQLAHIALTLIGEGEVFYEGKRRPTAEVMQKEKLSPLDIYIREGLSATNGTSVMTGIGLVNLIYAKRLLHWSIAASVMMNEIASSYDDLMSPGLNATKRHEGQQEIARAMCRWAAGSKAMRKREIEMFQRHTEKVFGHKVQAYYSLRCVPQILGPIWDTMAYAEKVLVDELNSACDNPIVDPEAQYVYHGGNFHGDYISFEMDKLKIAVTKMTMLAERQLNYLFHNRINDDILPPFVNLGVLGLNYGLQAAQFTATSTTAECQTLSNPMYIHSIPNNNDNQDIVSMGANAALMAKTVIENGYQVMAIHFMALVQAVDYLKLQPRMAEKTRAVYDEIRAFFPVFTDDTPKYREIETMITYLKSSGKRI

SEQ ID NO: 3 - DNA, 1602 bp, Wautersia metallidurans ATCC 43123
atgccccacgcccatccggccgacatcgacggccaccacctgacccccgacaccgtcgccgccatcgcacgcggccagcgcgccgccatcgtcccggagcccgtcctcggcaaggttgccgatgcccgcgcccgcttcgagcaggtggctgcggccaatgtgccgatctacggcgtctccacgggctttggcgaactggtacacaactgggtcgacatcgaacatggccgtgcgctgcaggagaacctgttgcgcagccattgcgcgggtgtgggtccgctgttttcgcgcgacgaggtccgcgcgatgatggtcgcgcgtgccaatgcgttggcacgcggatactcggcggtgcggccggccgttatcgaacaactgctgaagtatctggaagccggcatcacgccagccgtgccgcaggtgggttcgctcggggccagcggtgatctcgcgcctctgtcgcacgtcgccatcacgctgatcggcgaaggcaaggtgctgaccgaggatggcggtacggcacccacggccgaagtcctgcgcgagcgtggcatcacgccgctcgcgctggcgtacaaggaagggctggcgctgatcaacgggacatcggccatgaccggggtgtcgtgcctgttgctggagacgctgcgcgcgcaggtccagcaggccgagatcatcgcggcgctggcgctcgaaggactatccgcctcggccgatgccttcatggcccatgggcacgacatcgccaaaccgcatccgggacagatccgctcggcggcgaacatgcgcgcgctgctggccgattcggcacggctctccggacatggcgaactgtccgccgagatgaagacacgcgcgggcgaggccaagaacaccggcactggcgtgttcatccagaaggcctacacgctgcgctgcattccacaggtgcttggcgcggtgcgcgatacgctcgaccattgcgccaccgtggtcgagcgcgaactgaattcatcgaatgacaatccgctgttcttcgaagacggcgagctgttccacggcggcaacttccacggccagcaggtggcattcgcaatggacttcctggccatcgccgccacgcaactgggcgtggtgtcggagcgccgcctgaaccgcctgctgagcccgcatctgaacaacaatctgccggcgttcctggcggcggcgaacgaggggttgtcgtgcgggtttgccggggcacagtatccggccacggcgttgattgccgagaaccgcacgatctgcagcccggcgagcatccagagtgtgccgtcgaacggcgacaaccaggatgtggtcagcatggggctgatcgctgcccgcaatgcccgccgcattctcgacaataaccagtacatcctcgcgctggagttgctggcgtcatgtcaggccgccgaactcgcgggcgcggtcgagcaactggcgccggcaggccgcgccgtgttcgcgttcgtgcgggagcgcgtgccgttcctgtcgatcgatcgctatatgaccgacgacatcgaggctatggcggcgctgctccgtcagggcgcgctggttgaggtcgtgcgtggcgcgggcatcgaactggcctga

SEQ ID NO: 4 - protein, 533 aa, Wautersia metallidurans ATCC 43123
  DOMAIN (6)...(501): Phenylalanine and histidine ammonia-lyase
MPHAHPADIDGHHLTPDTVAAIARGQRAAIVPEPVLGKVADARARFEQVAAANVPIYGVSTGFGELVHNWVDIEHGRALQENLLRSHCAGVGPLFSRDEVRAMMVARANALARGYSAVRPAVIEQLLKYLEAGITPAVPQVGSLGASGDLAPLSHVAITLIGEGKVLTEDGGTAPTAEVLRERGITPLALAYKEGLALINGTSAMTGVSCLLLETLRAQVQQAEIIAALALEGLSASADAFMAHGHDIAKPHPGQIRSAANMRALLADSARLSGHGELSAEMKTRAGEAKNTGTGVFIQKAYTLRCIPQVLGAVRDTLDHCATVVERELNSSNDNPLFFEDGELFHGGNFHGQQVAFAMDFLAIAATQLGVVSERRLNRLLSPHLNNNLPAFLAAANEGLSCGFAGAQYPATALIAENRTICSPASIQSVPSNGDNQDVVSMGLIAARNARRILDNNQYILALELLASCQAAELAGAVEQLAPAGRAVFAFVRERVPFLSIDRYMTDDIEAMAALLRQGALVEVVRGAGIELA

SEQ ID NO: 5 - DNA, 1575 bp, Shewanella oneidensis ATCC 700550
atggaacaagtggtgcttgacggtaaacatttaacccaagatcaagcgtgggcaattgccgatggcgctaaagtaaaaattgccccacaagctaaaacccaattagtgaaagcacacgaactattgatggaagcggcgcgtcttggtaaacccgtttatggtctaaccgtcggtgttgggcttaacaaagatcacaaactgtttgatgctaatggcaaactgagtgatgcggtgctcgatgcttctagaagctttaactttagcaccttacgtgcccacagtgcgggcgtgggtgaggcggcacccattcgactcactcgcgtagctttagcggtgcggttaaataccatgctggccggacaaaccggtgtgcaacccgaagtggccgagctttatgaggcttatctcaataaggggctcacacccgtaatccctagcaaaggcacagtgggcgaagcggatattctgctttcatctcatgtgggtttagccatgattggcgaatgggaagtattctataaaggtcagcgtgttagcagcaaagaggctatggccgatgcgggcattacgccattagtcccaatgggtaaagatgcgttgtcgattttatctaacaacgcctttgctgtggcgtatgcgatgcaaggttaccgtgaggcgaaacaattattgtccgtgtcgccaacggtctttggcttaagcttggaaggcttaaatggtaacgtggcgccattcttgccacaaaccaatgatatccgcccgttcccttatattaaaactgccacgagtgacatcttaaaacaactcgatggcagctatttatggcagctaaatgatgagcgcccattgcaggatccgctgagctttagaaccacggcttacacctttgcgggcgccgagcaggcgttagcctcattggatgaagtcattaatatccaaattaaccactcccatgataaccctgcggtgattgtgggcgcgtcaaatcaatatgcccagttcccgcaagtggctaagtatgtggttgaaggacagggcggcgtattcccaaccactaacttcgaacctttacctgtagcattagcggtgcaaaacttgagtgtggcgctgacccatgtttcccataacagtgtgatgcgcacgattcatttgtccgatgagcactttactaagctaacgcgcttcttaagtgcgccagaaaaccaaggccatgcctttggtgctattcaaaaagcctttgtggatatgcaagtgcgtaacaaacagttagcgacgccagtctcctttgatggcatttctatcgcaggtggcattgaagataccttcactaaccttaagttagcatcagataacctgatccaaatcgtcgataacacccgagtcatctatggtttagagttattacactctactcaagcgattgatttacgtaagcaagctaacccagagctgcaactaggtaaagcgactcaagccatgtacaaggcttaccgtgcaaaagtgccttttgtcgcaaaagatcgcccattcacaccggatatccaagcgtctactgactttattacacattattaa

SEQ ID NO: 6 - protein, 524 aa, Shewanella oneidensis ATCC 700550
  DOMAIN (3)...(506): Phenylalanine and histidine ammonia-lyase
MEQVVLDGKHLTQDQAWAIADGAKVKIAPQAKTQLVKAHELLMEAARLGKPVYGLTVGVGLNKDHKLFDANGKLSDAVLDASRSFNFSTLRAHSAGVGEAAPIRLTRVALAVRLNTMLAGQTGVQPEVAELYEAYLNKGLTPVIPSKGTVGEADILLSSHVGLAMIGEWEVFYKGQRVSSKEAMADAGITPLVPMGKDALSILSNNAFAVAYAMQGYREAKQLLSVSPTVFGLSLEGLNGNVAPFLPQTNDIRPFPYIKTATSDILKQLDGSYLWQLNDERPLQDPLSFRTTAYTFAGAEQALASLDEVINIQINHSHDNPAVIVGASNQYAQFPQVAKYVVEGQGGVFPTTNFEPLPVALAVQNLSVALTHVSHNSVMRTIHLSDEHFTKLTRFLSAPENQGHAFGAIQKAFVDMQVRNKQLATPVSFDGISIAGGIEDTFTNLKLASDNLIQIVDNTRVIYGLELLHSTQAIDLRKQANPELQLGKATQAMYKAYRAKVPFVAKDRPFTPDIQASTDFITHY

SEQ ID NO: 7 - DNA, 1545 bp, Unknown
  Obtained from environmental sample
atgacccataaaatgacccataaaataattctaaacggtgaaaagttccagttggaagaggtggtggccattgcacgccagggggttggggttgccatttccgttggatcggaagcgcggatacaaaaggccagacaattggttgataaatgggtgaaggagggggttagaatatatggggtgaccacgggttttggcgccttgtccgatgtgaccatttcccttgaagacactaaaaaacttcagaaaaaaattcttttaagccattccgctggcatgggaaataatgtggcagacgatgtggtcagggccatgatggccctgcggatcaatgacttttgccggggcaattcaggcttgcgccttgaaaccattgaaaaactggcccagcttttaaacaccggcatcatcccggtggtgccggaaaaagggtctgttggcgccagcggcgatctagtgcccatggctcacctgtcactggttctcattggggagggggaagcctttgtggatggggtgcgcatgacaggggcaaaggcccttgcaaaaaaatccatatcccccctggaacttgaagcaggggaaggtcttgccctgatcaacggcacccagttcatgattgcccttggatgtcttgccctccatgatgccctgaacctgtgcaaacatgccgatattgccgccagtatgagtcttgaaaccctcatgggaacaagagctgcctttgatcccagaattcacagggcccggccgcatataggccagatgaaggcggcccggaacatgctcaaaatgacggaaaattccggcatcatctcctcccacagggactgctcccaggttcaggatgcctataccctgagatgttctccccaggtgcacggtgcctcctgggatgcctttgcctatgtggaccgggtgatccgggtggaaatgaattcctccacggaaaacccccttatttttccggaatccgaagagtttatttcgggtggtaacttccatggtcagcccctggccttggcttgtgattttttgggcattgccattgcagagcttgccaacatttcagaacggcgcattgaacgactggtcaatccccaattatctggactgccggcctttttggtggaagacgggggactcaactctggctttatgattgcccagtatgccgccgcttccctggtttccgagaacaaggtccttgcccatccggcttctgtggattccatccccacctcggccaacaaggaagaccatgtgtccatgggggcctttgccgctagaaaatgccggaatattgtggagaataccgaagaggtgattgccattgaactgctttgcggggcccaggccattgatctgtttaccaatttcaaggcaggagacggaaccctggccgcctatgaagtgatccgaaaaaaggtggattacagaaaagaagacaggcttttgtccacggatattgccaaggtcaaggcgttgctccgggacggcagcattgtaaacgccgtggaggctgcggtcggcaccctttattga

SEQ ID NO: 8 - protein, 514 aa, Unknown
  Obtained from environmental sample
  DOMAIN (8)...(482): Phenylalanine and histidine ammonia-lyase
MTHKMTHKIILNGEKFQLEEVVAIARQGVGVAISVGSEARIQKARQLVDKWVKEGVRIYGVTTGFGALSDVTISLEDTKKLQKKILLSHSAGMGNNVADDVVRAMMALRINDFCRGNSGLRLETIEKLAQLLNTGIIPVVPEKGSVGASGDLVPMAHLSLVLIGEGEAFVDGVRMTGAKALAKKSISPLELEAGEGLALINGTQFMIALGCLALHDALNLCKHADIAASMSLETLMGTRAAFDPRIHRARPHIGQMKAARNMLKMTENSGIISSHRDCSQVQDAYTLRCSPQVHGASWDAFAYVDRVIRVEMNSSTENPLIFPESEEFISGGNFHGQPLALACDFLGIAIAELANISERRIERLVNPQLSGLPAFLVEDGGLNSGFMIAQYAAASLVSENKVLAHPASVDSIPTSANKEDHVSMGAFAARKCRNIVENTEEVIAIELLCGAQAIDLFTNFKAGDGTLAAYEVIRKKVDYRKEDRLLSTDIAKVKALLRDGSIVNAVEAAVGTLY

SEQ ID NO: 9 - DNA, 1584 bp, Acinetobacter sp. ATCC 33305
atgaatacgactttgaatatcacccagccgcagacactgacggttggcttagagcctttgagtattgaagatgttgttcgtgtggctcaggcaaagtgccgtgttgcattacctgaacaacaagactggcgcgatttgattcagaaaggtgcagattttctggatactttgcttcaagaagaaggcgtcatttatggggtgaccacaggttatggagattcttgtctggtcgaagtgccgactcatcaagtgcatgaactgccgctacagctttcacgctttcatggttgtggacttgggcaaaatctggatctggtgactgcacgcgctgtggtcattacacgactctgttcgctggcacgtggttattctggtgtttcattggcattgctggaacgtctagtgtggttgctcaatgaaaatgtgattcctgtaattccttccgagggctcggtaggggcaagtggtgatctgacaccgttatcttatatcgctggagtattggtcggtgagcgagaggtgtattaccaaggcaagattattcctgtgcaacaggtgtatcagcaaaaagctatccagcctttaaccttgcgtcctaaagaaggtttggccttgatgaatggcactgcggtgatgaccgcaatcgcttgtttaaattataagcgggctgaacagattgcacagacagccacattagtcacagcaatcaatgtactggcactcgaaggtaatccgacacattttgatgaggtgttgtttgctcagaagccgcatacaggtcagcaaaaaattgcagcccaattgcgtgactggcttaacagcgaggtacaaaccgcacatcaaagcccacgattacaagatcgttattcgctgcgctgtgcgccgcatgtgattggtgtatttgaagattcaaaagtctggctacgtcagtttatcgaaaatgaattgaattctagcaatgacaacccgctgattgatcctgtgaatttgagagtgctgcatggtggacatttctatggcgggcatattgcacaggcgatggacagtttgaaaatcatgatcgcaaatattgcagacctgatggatcgtcagttggcacaattggtcgatcacaaaatgaatcatggtctgccgcgcaacctgacaggtgcaaccgcggaacgtttaccgctgaatcatggattcaaggcggtacagattggcgtatctgcatggacggctgaggcattaaaacagactttgtcggcatcgatcttctcacgatctaccgagtgtcataatcaggataaagtcagtatgggcaccattgctgcgcgtgatgcgacacgaattattgtattgactgaacaagtgatggctgcactgtgctgtgccagtatacaggcaatacatttgaagcagttggcacaacaattaagtccaaccctccgtgcatttagtgcatggaccttacacagtcttgcactggtgatcgaagaccgaccattacaaaccgaattgcaacagattgttgatcgttttgcccattttgagctgtctaatgcagattggatgcagcaacaggagcagctttatgcaggctga

SEQ ID NO: 10 - protein, 527 aa, Acinetobacter sp. ATCC 33305
  DOMAIN (12)...(492): Phenylalanine and histidine ammonia-lyase
MNTTLNITQPQTLTVGLEPLSIEDVVRVAQAKCRVALPEQQDWRDLIQKGADFLDTLLQEEGVIYGVTTGYGDSCLVEVPTHQVHELPLQLSRFHGCGLGQNLDLVTARAVVITRLCSLARGYSGVSLALLERLVWLLNENVIPVIPSEGSVGASGDLTPLSYIAGVLVGEREVYYQGKIIPVQQVYQQKAIQPLTLRPKEGLALMNGTAVMTAIACLNYKRAEQIAQTATLVTAINVLALEGNPTHFDEVLFAQKPHTGQQKIAAQLRDWLNSEVQTAHQSPRLQDRYSLRCAPHVIGVFEDSKVWLRQFIENELNSSNDNPLIDPVNLRVLHGGHFYGGHIAQAMDSLKIMIANIADLMDRQLAQLVDHKMNHGLPRNLTGATAERLPLNHGFKAVQIGVSAWTAEALKQTLSASIFSRSTECHNQDKVSMGTIAARDATRIIVLTEQVMAALCCASIQAIHLKQLAQQLSPTLRAFSAWTLHSLALVIEDRPLQTELQQIVDRFAHFELSNADWMQQQEQLYAG

SEQ ID NO: 11 - DNA, 1704 bp, Anabaena variabilis ATCC 29413
atgaagacactatctcaagcacaaagcaaaacctcatctcaacaattttcttttactggaaattcttctgccaatgtaattattggtaatcagaaactcacaatcaatgatgttgcaagggtagcgcgtaatggcaccttagtgtctttaaccaataacactgatattttgcagggtattcaggcatcttgtgattacattaataatgctgttgaatctggggaaccaatttatggagtgacatctggttttggcggtatggccaatgttgccatatcccgtgaacaagcatctgaactccaaaccaacttagtttggttcctgaaaacaggtgcagggaacaaattacccttggcggatgtgcgcgcagctatgctcttgcgtgcaaactctcatatgcgcggtgcatctggcatcagattagaacttatcaagcgtatggagattttccttaacgctggtgtcacaccatatgtgtatgagtttggttcaattggtgcaagtggtgatttagtgccactatcctacattactggttcactgataggcttagatcccagttttaaggttgacttcaacggtaaagaaatggatgcgccaacagctctacgtcaactgaatttgtcacccttgacattgttgccgaaggaaggcttggcgatgatgaacggcacttcagtcatgacaggtattgcagcaaactgcgtctacgatactcaaattttaactgcgatcgctatgggcgttcacgctctagatatccaagctttaaacggaaccaatcaatcattccatccatttatccataattccaaaccacatcctggtcaattatgggcagcagatcagatgatttctttgttagccaattcccagttagttcgtgatgagttagatggtaaacacgattatcgtgatcacgagttgattcaagatcgttactcactccgatgccttccccagtatttggggccaatcgttgatggaatttcccagattgccaaacaaattgaaatcgaaatcaactcagtcaccgataacccactaattgatgttgataaccaagctagctatcatggaggaaatttcctcggacagtacgtgggtatgggaatggatcacctgcgttactatattgggttattggctaaacacctagatgtgcagattgccctcctcgcctcaccagagtttagcaatggactaccaccatctttattaggcaaccgagaacgtaaagtcaatatgggactcaaaggtctgcaaatatgcggtaactcaattatgccactgttgaccttctatggaaattccatcgccgatcgctttcctacccatgcagaacaatttaatcagaacatcaacagtcaaggatacacttcagcgactctagcccgccgttctgtggatatcttccagaattatgtggcgatcgctctgatgtttggagtccaagctgttgacctccgcacatataaaaagactggtcattacgatgcacgcgcctgtctatcacctgcaactgagcgcttatattcagcagtccgccacgtagttggacaaaaaccaacttcagatcgcccatatatttggaatgataatgagcaaggactggatgagcatattgcccggatttctgctgatatcgctgctggtggtgtgattgtgcaagcagttcaagatatcttaccctgcttgcattaa

SEQ ID NO: 12 - protein, 567 aa, Anabaena variabilis ATCC 29413
  DOMAIN (25)...(524): Phenylalanine and histidine ammonia-lyase
MKTLSQAQSKTSSQQFSFTGNSSANVIIGNQKLTINDVARVARNGTLVSLTNNTDILQGIQASCDYINNAVESGEPIYGVTSGFGGMANVAISREQASELQTNLVWFLKTGAGNKLPLADVRAAMLLRANSHMRGASGIRLELIKRMEIFLNAGVTPYVYEFGSIGASGDLVPLSYITGSLIGLDPSFKVDFNGKEMDAPTALRQLNLSPLTLLPKEGLAMMNGTSVMTGIAANCVYDTQILTAIAMGVHALDIQALNGTNQSFHPFIHNSKPHPGQLWAADQMISLLANSQLVRDELDGKHDYRDHELIQDRYSLRCLPQYLGPIVDGISQIAKQIEIEINSVTDNPLIDVDNQASYHGGNFLGQYVGMGMDHLRYYIGLLAKHLDVQIALLASPEFSNGLPPSLLGNRERKVNMGLKGLQICGNSIMPLLTFYGNSIADRFPTHAEQFNQNINSQGYTSATLARRSVDIFQNYVAIALMFGVQAVDLRTYKKTGHYDARACLSPATERLYSAVRHVVGQKPTSDRPYIWNDNEQGLDEHIARISADIAAGGVIVQAVQDILPCLH

SEQ ID NO: 13 - DNA, 1581 bp, Streptomyces carzinostaticus subsp. neocarzinostaticus  ATCC 15944
atgaccacagctgagaccgccactggtccggtcgtcgtcgacggcgagagcctcagcgtcgatgccctgcgtcaggtcgcggagtcagggacccccgtgaaggtccacaccgaagcgatggagaaggtactcaggagccgtgcctcgctggagagcatgatcattcgcggcgagcccgtacctggtgccgtcggcggtgacggccgtgagagcccgccaggcatcgatgtggcgcgggagtccgaacggcagacgaacctggtgcgcagccacagcgtcggcgtcgggcccctgtacgccgaggacgaggcacgagccatggtgacggcgcgtctgaactctctggccaaagggcactcggccgtgcgaccggacatactcgaccgcatggtgctctatctgaacgaggggataatcccggccgtgcccgagatcggatcatctggtccggttgatctcgttcccctcgcccatgtggcaagcaccctgatcggggaagggcatgttctgcacgacggcaggcgccaggagacccgcagggtcctgggcgcgatgggagtcgcaccgctccggctcggtgtcaaggagggcactgcgctgatcaatggcacgtcgggcacggtcggcctgggagcgctcgtggtggcacgagcccttgaccaggtgcgccaggcagagatcgcctcggccttcttcgacgacgcggtgcgaggttccgacagcccgttcctggccgaaggacatgacacggcccgtccacatcgggggcagatcgactcggccgccaacttgcgtgatctgctggcggacagccgggggcggcgggaaacggagcacgggggtgccgtgctcgggttcccggggccgcaggtacccggcttctacacggcacgcacggtgccgcaggtgctcggcgcggcccgggacgccctccggcacgctacggaggagctggaggcagaactcaactccgcgaacgacgaacctctcttcttaccggacggaaaagtcctccacggcggaaccgcccaggggcgggccgtggcgctcgccctggagtttgtcgccatcgcgctcagccacgtcggcgagctggccgaacggcagatcgaccgcatgctcacccggcgtccggcctccggcgttgcgcggtacctcgtggcggcggatccgacgctgcaccatggtttcgcgggcgtcggccacacagcgcgggccctcacggcggagaacctggcggtcggcactgccgctgctcaggtcgttaccgccttcggcgacgaccggccaacggccggcaccgggctcctggcggcccgcaacgcacgacgcgtgctgcagaacaatgatcggatcattgccattggcctcatcgtcgcagctcaggccgccgacctcgctcggagattcgatgatctgagccgggcgaacatggccacgtacgacatggtgcgttccctggtcccgtccctcggcgtcgaccgttcgatggcgcaggacgtcgagttgatcgccactgccctgtcccgggcagagttcctccatctgctcctgcggcaggaggggatcgttctgcgctga

SEQ ID NO: 14 - protein, 526 aa, Streptomyces carzinostaticus subsp. neocarzinostaticus  ATCC 15944
  DOMAIN (10)...(493): Phenylalanine and histidine ammonia-lyase
MTTAETATGPVVVDGESLSVDALRQVAESGTPVKVHTEAMEKVLRSRASLESMIIRGEPVPGAVGGDGRESPPGIDVARESERQTNLVRSHSVGVGPLYAEDEARAMVTARLNSLAKGHSAVRPDILDRMVLYLNEGIIPAVPEIGSSGPVDLVPLAHVASTLIGEGHVLHDGRRQETRRVLGAMGVAPLRLGVKEGTALINGTSGTVGLGALVVARALDQVRQAEIASAFFDDAVRGSDSPFLAEGHDTARPHRGQIDSAANLRDLLADSRGRRETEHGGAVLGFPGPQVPGFYTARTVPQVLGAARDALRHATEELEAELNSANDEPLFLPDGKVLHGGTAQGRAVALALEFVAIALSHVGELAERQIDRMLTRRPASGVARYLVAADPTLHHGFAGVGHTARALTAENLAVGTAAAQVVTAFGDDRPTAGTGLLAARNARRVLQNNDRIIAIGLIVAAQAADLARRFDDLSRANMATYDMVRSLVPSLGVDRSMAQDVELIATALSRAEFLHLLLRQEGIVLR

SEQ ID NO: 15 - DNA, 1593 bp, Shewanella oneidensis ATCC 700550
atggcaactcatacgcttgatggcacttcattgactgtagataaactttgggaaatatctaagtctggtgaagatgttaacatttcgaaagaaggttgggagcgtattcgagcgtcttataaagcgcctattgatgcagctgaagatgggcgttctatttatggattaaccgttaattacggtgctctgaaagaccagcgtgtcgcgggggcttcggtcgaaaatgagccgaatcgttcagaatctattaaatttaatgagcggcaaatgcggatacaagcagcggggatggagccatttttacctgaagctgaatctaaaatggcgatggttatccgtttgaaccagatggctgcaggatttacagggatgagtgttgatgctgccaatgcctatatggaatatatcaacaatgatgtttatccacttattccatctcgaggctcagaaggtgccaatgatttgagtatggtgacacatgtcggtttagccttaatgggtgagtgggatgtaatgtaccaaggaaagcgtcgctcttcagctgaggttcgtaaagagctaggattgaaaaaatatcagccatttgggatggatggtatttcaattctctcaaatagtaatgttgccgaagcacaatctattacggcagtgaaaaaagtggagcatctactcgatctatcatcagtgataattgcgtctagtttagaagcgctaaatggtaacgtgtccccttttctatggcatacagtcgatacaaaaggatggccacagggacatgaagcggcggaatcaattttatctcatttaaaaggttcatatctttggagtcttgattcgaagcgaaatttacaggacccgttgagctttagatcatcaggtcaaattttagcggcagcgaaagaagaattacgccaagcaaaagagttacttaatacagcaatcaaccatacgacagacaatccaattgtgcatacaaatgcaagagatgatttatggtacagcaatagcgattatgttgatggcttacgggttggtggaaaaaatgtttttgttaactcaggttctaattttgataatacccagctagcagtgcagttggagtctttgagtcgtgcacttgcccaagtgattcatatttcagcctggcgtactacccaattagatgacggtcaccgtacaaaattaacaacatatttaatttctaaggaaaatgttggtggtgatggttttgctaatatcgcacaatctatgtctggtctttatgcggaagcgatgtctttgactaatagtgctgcaatttatggcgtaccaacatctgttggtattgaggaaacctttagtaacgtcaatttaattgcaaatcgcttagataaaattgcagatattgcttatgaaatttactcttatgaggtgttgcataccacacaaggtatggatatcagaacaaaagaatatagccaaaaaatggggaatggtacgagtgaatttcttcatgaataccgtaaatatgttccatttgtatctaaagatagaatttacactcctgatataaataacggtgttaaatttttaaaaacctacagtacaagataa

SEQ ID NO: 16 - protein, 530 aa, Shewanella oneidensis ATCC 700550
  DOMAIN (3)...(505): Phenylalanine and histidine ammonia-lyase
MATHTLDGTSLTVDKLWEISKSGEDVNISKEGWERIRASYKAPIDAAEDGRSIYGLTVNYGALKDQRVAGASVENEPNRSESIKFNERQMRIQAAGMEPFLPEAESKMAMVIRLNQMAAGFTGMSVDAANAYMEYINNDVYPLIPSRGSEGANDLSMVTHVGLALMGEWDVMYQGKRRSSAEVRKELGLKKYQPFGMDGISILSNSNVAEAQSITAVKKVEHLLDLSSVIIASSLEALNGNVSPFLWHTVDTKGWPQGHEAAESILSHLKGSYLWSLDSKRNLQDPLSFRSSGQILAAAKEELRQAKELLNTAINHTTDNPIVHTNARDDLWYSNSDYVDGLRVGGKNVFVNSGSNFDNTQLAVQLESLSRALAQVIHISAWRTTQLDDGHRTKLTTYLISKENVGGDGFANIAQSMSGLYAEAMSLTNSAAIYGVPTSVGIEETFSNVNLIANRLDKIADIAYEIYSYEVLHTTQGMDIRTKEYSQKMGNGTSEFLHEYRKYVPFVSKDRIYTPDINNGVKFLKTYSTR

SEQ ID NO: 17 - DNA, 1500 bp, Unknown
  Obtained from environmental sample
atgattgagcttgatggcgtctcattaacgttggggcaaacggaagcagtggctttcggcgaagaagtctctttagtgtcggacgcccgcgaacgcgtcgaacgcgcgcgcggcttcatcgaagaaatcgtcgcgcgcaacgaggtggtttacggcgtcaacaccggcttcggcgcgctctccgaagtcagtatagcggtggacgaactacgcgaactgcaactgaacctcgtgcgctcgcacgcttgcggggtcggcgaaccgctgcccgaggcggccgtgcgcgcgatgatcttgcatcgcgccaacgtgttggccaaaggattctcgggctgccggccggcggtgatcgatacattgattgcgatgttgaacggcggcgcgcatccggtcattccgtcgcgcggttccgtgggggcttcgggcgaccttgcgccgttggcccatctggcgctggtggccatcggcgagggcgaggcgatcttccgcggcgagcgcatgccgggcggcgaggcgatgcggcgcgcgggaatccgcccgctccggctcgaagccaaagaagggctggcgctgctcaacggcacgcaggggatgaccgccgtaggcggactggcgttgctcaacgccgtgagactgtccgaagcggcggacgtgatcggggctatgacgctcgaagccttgagaggcacgccggtggctttcgacgaaaagattcattcggcgcgtccccaccccggccagcaagcgagcgcgcggcggttgcgcgatttgatcgaagggagcgagattcgcgagtcgcaccgcgaccgcgccgtcgatccgcgcgtgcaagacgcatacgcgttgcgctgcatgccgcaggttcatggcgccgtgcgcgacgcgctcgaacacgcccgcggcatagtcgaggtcgagatcaacagcgccacggacaacccgctggtcttcaccgatgagcgtgaggtcttgtcgggaggcaattttcatggcgagccggtcgcgctggcgctcgattacgcggcgatcgcagtggccgatctgggcacgatcgccgagcgccgcgtcgagcgcctggtcaacccgacgctttcggggctgccggcgtttctgtcgccgtatccgggaaccaattcggggatgatgatcgcgcaggtcacggccgccgcgctgatcgccgaaaacaacgtgctggcgcatccggcttcggtcttcactcttccgacttcggccaacaaggaagaccatgtttcaatggggatgacggcggcgttgaagttcgcgcaagtggtcaacaacgtagagaccattctggcgatcgaattgctgtgcgccgcgcaggggctggagttcttgaaacccttgaaacccgggcctaagctgcgggatgtttatgatcgcgtccgcctgcgcgcgcccgcgctcgaacgcgacgcgccgctcgcgccttacatagaatcgctcaagccggttgttcgtgagctggagcaggttttataa

SEQ ID NO: 18 - protein, 499 aa, Unknown
  Obtained from environmental sample
  DOMAIN (1)...(477): Phenylalanine and histidine ammonia-lyase
MIELDGVSLTLGQTEAVAFGEEVSLVSDARERVERARGFIEEIVARNEVVYGVNTGFGALSEVSIAVDELRELQLNLVRSHACGVGEPLPEAAVRAMILHRANVLAKGFSGCRPAVIDTLIAMLNGGAHPVIPSRGSVGASGDLAPLAHLALVAIGEGEAIFRGERMPGGEAMRRAGIRPLRLEAKEGLALLNGTQGMTAVGGLALLNAVRLSEAADVIGAMTLEALRGTPVAFDEKIHSARPHPGQQASARRLRDLIEGSEIRESHRDRAVDPRVQDAYALRCMPQVHGAVRDALEHARGIVEVEINSATDNPLVFTDEREVLSGGNFHGEPVALALDYAAIAVADLGTIAERRVERLVNPTLSGLPAFLSPYPGTNSGMMIAQVTAAALIAENNVLAHPASVFTLPTSANKEDHVSMGMTAALKFAQVVNNVETILAIELLCAAQGLEFLKPLKPGPKLRDVYDRVRLRAPALERDAPLAPYIESLKPVVRELEQVL

SEQ ID NO: 19 - DNA, 1542 bp, Unkown
  Bacteria
atgcagacagtcgtcctcggcacgtccggcacgaccccgcaggacgtcatcgacgtcgcccgtcacggcgcccgcgtcgagctgtcgcccgaggccgtggaggccctggccgccgcccgggacatcgtcgacgcgctcgccgccaagcccgagcccgtctacggggtctccaccggcttcggcgcgctcgccacccggcacatcggccatgagctccgcgcccagctccagcgcaacatcgtccgctcgcacgccgccggcatgggcccgcgcgtcgagcgcgaggtcgtccgcgccctcatgttcctgcggctgaagaccgtcgcctccggtcacaccggcgtccgccccgaggtcgcgcagaccatggccgacgtcctcaacgccggcatcaccccggtcgtccacgagtacggctccctcggctgctccggcgacctcgccccgctctcccactgcgccctcgcgctcatgggcgagggcgacgccgagggccccgacggcgtggtcaagccggccggcgagctgctcgccgccgccggcatcgcgcccgtcgagctcaaggagaaggagggcctcgccctcctcaacggcaccgacggcatgctcggcatgctgatcatggccctcgccgacctcgacaccctctacaagtcggccgacatcaccgccgcgctctccctcgaagccctcctcggcaccgagaaggtcctcgaacccgagctgcacgccatccgcccgcaccccggccaggccgcctccgccgccaacatgctcgccgtgctcaagggctccggcctcaccggccacgccctcgccggcgaggccccgcgcgtccaggacgcctactcggtgcgctgcgccccgcaggtcgccggcgccggccgcgacaccatggcccacgcccggctcgtcgccgagcgcgaactggccgccgccgtcgacaacccggtggtgctgcccgacggcacggtccgctccaacggcaacttccacggcgcccccgtcgcgtacgtcctcgacttcctcgcgatcgccgccgccgacctcggctccatcgccgagcgccgcaccgaccggctcctcgacaagaaccgctcgcacggcctgccgcccttcctcgccgaggacgcgggcgtcgactccggcctgatgatcgcccagtacacgcaggccgccctggtcagcgagatgaagcggctcgccgtcccggcctccgccgactccatcccgtcctccgcgatgcaggaggaccacgtctccatgggctggtccgccgcccgcaagctgcgcaccgcgatcggcaacctcaaccggatcatcgccgtcgagctgtacgccgccacccgcggcgtcgagctccgcgagggcctgaccccggcccccgccagccgggccgcgatcgccgccctgcgcgcggccggtgtcgagggtcccggcccggaccggttcctcgcccccgacctggcggccgccgacgccttcgtacgcgaagggaagctgctcgccgcggtggagccggtcaccggcccgctggcctga

SEQ ID NO: 20 - protein, 513 aa, Unknown
  Bacteria
  DOMAIN (2)...(480): Phenylalanine and histidine ammonia-lyase
MQTVVLGTSGTTPQDVIDVARHGARVELSPEAVEALAAARDIVDALAAKPEPVYGVSTGFGALATRHIGHELRAQLQRNIVRSHAAGMGPRVEREVVRALMFLRLKTVASGHTGVRPEVAQTMADVLNAGITPVVHEYGSLGCSGDLAPLSHCALALMGEGDAEGPDGVVKPAGELLAAAGIAPVELKEKEGLALLNGTDGMLGMLIMALADLDTLYKSADITAALSLEALLGTEKVLEPELHAIRPHPGQAASAANMLAVLKGSGLTGHALAGEAPRVQDAYSVRCAPQVAGAGRDTMAHARLVAERELAAAVDNPVVLPDGTVRSNGNFHGAPVAYVLDFLAIAAADLGSIAERRTDRLLDKNRSHGLPPFLAEDAGVDSGLMIAQYTQAALVSEMKRLAVPASADSIPSSAMQEDHVSMGWSAARKLRTAIGNLNRIIAVELYAATRGVELREGLTPAPASRAAIAALRAAGVEGPGPDRFLAPDLAAADAFVREGKLLAAVEPVTGPLA

SEQ ID NO: 21 - DNA, 1518 bp, Unknown
  Obtained from environmental sample
atggggagtaccgcacatttcaccattttggatggtgggtcgctgccaatcaacgatattttaggggtggcacgacgcgggcaaatggtcatgctgcatcgctcggcccgtgaaaaaattgaagcagcctatcaagtcgttgaagcagttgtggcacagggcaaagttgcttatggtgtcaatacaggttttgggagcctaaatcgggtacgtatcccgcccgaacaagttcaacaagtccagcgtaatctcatccgtagtcattcggcagggattggcgatattctgccggaagaaatcgtgcgggcgacaatgctgattatgactgccagtctctgtcggggctattcaggggtgcggcctattgtggtcgaaaccttaatgaatgttttgaacgcgggcattacgcctgttgtgccttcacgcgggtcagtcggggcgagtggcgaccttgcgcccctttcgcatatcgcccttgtgttgattggtgagggggaagcgttttataaaggcgaaaaaatcagcggcggggcggcgcttcaacaagtcggtattgaaccgctaatcctcgatgccaaagaaggcttggccctcattaatggcacgcatctgatggcggcgatggcggcgcttttgattgttgataccgaacgattattgggggcagccatcaccgcagcggccctttcgattgatgcctgtcgtgctacggatgtttttttggacgggcgggtgcatatgattcgccaacagcatggacaggtgcgggtagctgacaaaattcgcaccttattagagggcagcaccattctgccaagtcacaaaaccgatgacccgcgtgtgcaagacccctattcgttgcgctgcaccccccaagtgcttggggcagcatcggatatggtggattatgtcaccgaaattatcacccgtgaattgggcgcggtaacggataacccgttggtatttcccgataatggcgacatcatcagcgcgggcaattttcatgggatgccgatagcgttagccctcgattcgttaaaaatcgcggtggcgcatatcgcggggattagcgaacggcgcgtgtactttttattgagtgcctctgacagcgaaaatccgttaaacccgcatctcagccccgaaccgggattacacagcggcctcatgattgcccaatatactgccgccgctgcctgcaatgaaatccaaacattggcaacacctgccagcgtgcataatatcccaaccagcgcgggcatggaagattacaatagcatgggggcgacatcagcccatcaagcatggcaggccgtcaaactggctactcatgtcattgcgattgaacttttatgttcggctgaggcattggaatatcaacgcccgttgaagagtggggcagggattgaaaaagcccatgcgaggattcgccagcatgtcccccgtttgaccgcagaccgttcacccacccccgatattgaaaaaattgttcagttgattcgacagggagcatttccataa

SEQ ID NO: 22 - protein, 505 aa, Unknown
  Obtained from environmental sample
  DOMAIN (7)...(484): Phenylalanine and histidine ammonia-lyase
MGSTAHFTILDGGSLPINDILGVARRGQMVMLHRSAREKIEAAYQVVEAVVAQGKVAYGVNTGFGSLNRVRIPPEQVQQVQRNLIRSHSAGIGDILPEEIVRATMLIMTASLCRGYSGVRPIVVETLMNVLNAGITPVVPSRGSVGASGDLAPLSHIALVLIGEGEAFYKGEKISGGAALQQVGIEPLILDAKEGLALINGTHLMAAMAALLIVDTERLLGAAITAAALSIDACRATDVFLDGRVHMIRQQHGQVRVADKIRTLLEGSTILPSHKTDDPRVQDPYSLRCTPQVLGAASDMVDYVTEIITRELGAVTDNPLVFPDNGDIISAGNFHGMPIALALDSLKIAVAHIAGISERRVYFLLSASDSENPLNPHLSPEPGLHSGLMIAQYTAAAACNEIQTLATPASVHNIPTSAGMEDYNSMGATSAHQAWQAVKLATHVIAIELLCSAEALEYQRPLKSGAGIEKAHARIRQHVPRLTADRSPTPDIEKIVQLIRQGAFP

SEQ ID NO: 23 - DNA, 1542 bp, Cytophaga hutchinsonii ATCC 33406
atgataacgattggagaccagatagtaacactagatcaattaaaggggtttttatattcaaacgaacaacttgagatcagtgcagcagcgattgaacgagtaaaaagaaatcatcagtttttgatacatttttctaccgataaaatcatttatggtattaatactggatttggtccgatggctcaataccgcgttagtgatgaagatcgtaaaaccttacagtataatttaatccgcagccattgttcaggtacaggtaatgcacttgatccgatctatgttaaagcagccatgattgttcgcttaaacagcttcctgatcggaaaatccggcgtacacgaaagtctgatatttctattgcgcgatctgatcaacaacaatattacgcctgttgtatttgaacacggtggtgttggggcaagcggtgatttagtgcagctggcacatttgggacaatgtctgatcggcgaaggttctgtgcactacaagggagagatccgtgaggctgcagaagtatttgcagaagcaggtatttcaccgataaccattcagatcagagaaggcttagccgtaatgaacggaacttcttttatgacaggtattggtgtggtgaatttaattcaggcacaaaatcttgtaaactggtcggtgaacgcagcatcattgatcaatgaactgatcgcttcatacgatgattatttttcttctgaactgaacgatgtgaaattacatgccggccagcgtaaagtagccgcacagataagagaacgtttagaaggtagtacgctgatcaaatcacgtgctacgcatttatacaaaaaagtggatgaaatgtattttgaagataaagttcaggaatactattcgatccgttgtgtaccacagatcgttggccctatcagcgataccattgaatatgcaacaacagttattgaaaatgaagtaaactctgttaacgacaatccggttgttgacgaagctgccaataatatttatcacggcggtaatttccatggcgattacatttcgctggaaatggataaagtgaaaattgctattacaaaacttgccatgctggcagaacgtcaggtgaattatttaatgaacagcaaattaaataatatgcttccgccgtttttgaataaaggtgtgttagggttgaattttggtttacaaggggttcagtttacagctacatcaaccgttgcagagtgccagacattagcaaacccaatgtatgtacacagcataccaaacaataacgacaatcaggatattgtaagtatgggtacaaactctgccttgatatgcagcaaagtaattgagaacgcatatcaggtaattgccattgaattgatgtctattacacaagctattgatatattaaaattaaacgatcgcttatccgtatataactcttcggtattggcaacgatacatactgcgtttgttccattcacagaagatcagcctaaatacaaagagatacgcaacgtattatccaaacttagaatttctatttctaaagaaactgttaagtaa

SEQ ID NO: 24 - protein, 513 aa, Cytophaga hutchinsonii ATCC 33406
  DOMAIN (1)...(481): Phenylalanine and histidine ammonia-lyase
MITIGDQIVTLDQLKGFLYSNEQLEISAAAIERVKRNHQFLIHFSTDKIIYGINTGFGPMAQYRVSDEDRKTLQYNLIRSHCSGTGNALDPIYVKAAMIVRLNSFLIGKSGVHESLIFLLRDLINNNITPVVFEHGGVGASGDLVQLAHLGQCLIGEGSVHYKGEIREAAEVFAEAGISPITIQIREGLAVMNGTSFMTGIGVVNLIQAQNLVNWSVNAASLINELIASYDDYFSSELNDVKLHAGQRKVAAQIRERLEGSTLIKSRATHLYKKVDEMYFEDKVQEYYSIRCVPQIVGPISDTIEYATTVIENEVNSVNDNPVVDEAANNIYHGGNFHGDYISLEMDKVKIAITKLAMLAERQVNYLMNSKLNNMLPPFLNKGVLGLNFGLQGVQFTATSTVAECQTLANPMYVHSIPNNNDNQDIVSMGTNSALICSKVIENAYQVIAIELMSITQAIDILKLNDRLSVYNSSVLATIHTAFVPFTEDQPKYKEIRNVLSKLRISISKETVK

SEQ ID NO: 25 - DNA, 2238 bp, Botrytis cinerea ATCC 204446
atgggtgcttccaaccaaacagttgtgactgccagatatcaaggaacgaaaatggattgcttcaatcagatgatcttgtcgcattggaaagacttctcacgtgcaattgaagatgaagactctggactcgagccaataagggccgatggctctagcttgaacctagcgaccttggttgccatagcgagataccgtcgcaaaatatcactcagcgaagaagcaaccagaaagatgaagaaaagtgtaaatgcttttcaaaaacggatccaagacggcgagtcagtttatggtgtcaataccggttttggtggaagcgccgatgttcgaccaaagaacatctccgaagtatctgcaagcttatttcgaatgcttcattacggaattatttctggtcctctagatagtcgtcatgttggagagttagcaacaaacgacccaatgagcgctgtgaagcagagggagtctaaaactgcgaaactagcaagattagctattccgttatctgatcccgtttgctcaaccaccatgccagagagctgggttcgtggtgcaatggctattcgtgccaatacgcttgccaaaggagcctctgcagttcgaccagtcattgttcagtctctgttcgatcttttgaacaaggaaattatcccagccgtgccacttcggggaagcatatctgcttccggtgaccttagtccgttgtcatacataggtggagcactggaaggaaagtcggcgattcaggtttacgtcgattttgatcggaaacgtgtttcagcagacaaagcattattgcaagctgatatagcccccgcagttttcgggcctaaagagggactgtcgttggtcaatggaacagcagtaacagcttccgttgcagctttagccatgcatgaagccattatgcaagctttgctttcacaaattcttactgctatgtctgttgaagcactttctggtacggacgaaagctttaatcctttttttgccgaggtcagaccccatagaggtcagacgatatcagccaaaaatattcactcattcttggctggatccaagttgacaaaaggaaatgatactcaagaatttcaattacgacaggatcgctattctattagaactgcatcacaatggattggtccatcactagaggatcttttgttatcctacgagcaggtatcaattgagttaaactccaccactgataatccccttgttagtgatgacggaaagatacgtcatggtggaaattttcaagcgaagtccatcacaagtgccgtggagaagactagacaagcttgccagtcgattggtcaaatgttatttgcacagtgtaccgagttgataaatccagcaacaaacaacggtcttcctcctaatctggtggcagacgagccaagcgaatcctggatgttcaaaggtattgatatcatgattgcggcattgcaatctgagcttggttttttgtctaaccccgttggatcacatgttcagacggctgaaatgggcaatcaagctttgaattctctggggctcatctcgagtagatacacgctatcggctttggaagttctgacgcagctttccgcggcacatctagtggctgtatgccaagctctagatctcagaggaatccaaaatctattttttatgaatttaaagcctaagtttgagggctctttcattcagtgccttggaaaatatcccgtggcacgccctagtgaatgggacgatcccatggagacgaaggaatcctccaaactacaactgctcctctgggaaaaactgacaacaacgctcaattcgagttcaaatatggactcgaccacgcgctttaaacatacagctcagtcgcttcaggcagtcattcttgaaacgttggagcccagtctagaaatgttgcaagttttgaaatgctggaccgaattgtgctcggagcaaatgatttacgcccacacattggcaaagagacaacattttgaatcaactgcgatggctaagttctttttgggcaaagctggtgagcggatgtatcgctatttacgcaatgagctccacatacctttcgttgatgaggaatacctcaagtcttcggaatggttgcccgagaagcctgactcatatcaatctgtcggaagtatggtaaccgcggtgtatgaaagtatgagatcgggtgagctatattctgttgctatcgagtgcttgaaagatgcagaagaggaagtaaggaatgaatag

SEQ ID NO: 26 - protein, 745 aa, Botrytis cinerea ATCC 204446
  DOMAIN (45)...(570): Phenylalanine and histidine ammonia-lyase
MGASNQTVVTARYQGTKMDCFNQMILSHWKDFSRAIEDEDSGLEPIRADGSSLNLATLVAIARYRRKISLSEEATRKMKKSVNAFQKRIQDGESVYGVNTGFGGSADVRPKNISEVSASLFRMLHYGIISGPLDSRHVGELATNDPMSAVKQRESKTAKLARLAIPLSDPVCSTTMPESWVRGAMAIRANTLAKGASAVRPVIVQSLFDLLNKEIIPAVPLRGSISASGDLSPLSYIGGALEGKSAIQVYVDFDRKRVSADKALLQADIAPAVFGPKEGLSLVNGTAVTASVAALAMHEAIMQALLSQILTAMSVEALSGTDESFNPFFAEVRPHRGQTISAKNIHSFLAGSKLTKGNDTQEFQLRQDRYSIRTASQWIGPSLEDLLLSYEQVSIELNSTTDNPLVSDDGKIRHGGNFQAKSITSAVEKTRQACQSIGQMLFAQCTELINPATNNGLPPNLVADEPSESWMFKGIDIMIAALQSELGFLSNPVGSHVQTAEMGNQALNSLGLISSRYTLSALEVLTQLSAAHLVAVCQALDLRGIQNLFFMNLKPKFEGSFIQCLGKYPVARPSEWDDPMETKESSKLQLLLWEKLTTTLNSSSNMDSTTRFKHTAQSLQAVILETLEPSLEMLQVLKCWTELCSEQMIYAHTLAKRQHFESTAMAKFFLGKAGERMYRYLRNELHIPFVDEEYLKSSEWLPEKPDSYQSVGSMVTAVYESMRSGELYSVAIECLKDAEEEVRNE

SEQ ID NO: 27 - DNA, 1623 bp, Burkholderia cepacia ATCC 17616
atggaggtccgcgtggccgagcatgagatgagcgacgtcgcggcaagcgccgcggcggcagcgggccgggcggccgtcgtggtcggcgcacggcatctgacgatcgaggacgtcgtcgcgatcgcgcgcgacggcgcgccgctcgcactgaacgcggcgcccgcctggcgcgcgcggatcgagcgcggtgcagcgtggctgcgcgaccatctcgcgaacggcggcaccgtgtacggcgtcacgaccggatatggcgacgcgtgcgtcgtcgacgtgccgccgtcgctcgtcgaagcgctgccgctgcagctgacgcgctatcacggctgcggaatgggcgactggttcgacgcgacccaaacgctgtcgatcgtcgtcgcgcgcctgaactcgctcgcgttcggctactcgggcgtgcgcttcacgttgctcgaacggctggccgacatggtgaatcaccgcatcctgccgcgcattccgtcggaaggttcggtcggcgcgagcggcgatctgacgccgctgtcgtacgtcgccgcggcgctggtcggcgagggtagcgtcgggttcgccggcggcgagtgcgacgcgcgcgacgcgtggcgcgcgatcgatcgcacgccgctcacgctcgcgccgaaggaggggctcgcgctgatgaacggcacggccgtgatgacgggcctcgcgtgtctcgcgtttgcgcgcgccgaccacctgacgcgcatggcggcgcgtctgaccgcgttgacgaccatcgcgctcgacggccgcgccggacacttcgacgcgcggctgttcgacgcgaagccgcacgcggggcaggcggaggcggcggcgtggattcgcgccgatctggccgggcgcgacgaattgccgggccgccggctgcaggaccgctattcggtccggtgcgcgccgcacgtgatcggcgtcgcacgcgacgcattgtcgtggatgcgccgcgatatcgagaacgaactgaacagcgcgaacgacaacccgctgatcgacccggacgaaggctgcgtgctgcacggcggcaatttctacggcgggcacatcgcgttcgcgatggacgcgctcaagaccgcggtggccaatctggcggacctgatggaccgccagctcgcgctgctggtcgacgacaagttcagcaacggcctgccgcgcaacctgagcggcgccgcgcccgagcgtgcggcgatcaaccacgggttcaaggccgtgcagatttcgtcttccgcatggacggccgaagcgctgaagcacacgatgccggcgagcgtgttctcgcgttcgacggaatcgcacaatcaggacaaggtcagcatgggcaccatcgccgcacgagattgcctgcgcgtgctggcgctcaccgagcaggtcgccgccgcgcacgtgctcgcgaccgtgcaggccgtgcgcttgcggctgcgtgacgatccgcacgcgcagctgacgccggcgctgcgcgcgttcgtcgacgacgtgggccggcaatcgccgctcgtggtcgaggaccggccgctcgaagcggaactgcgtgcgctgtgcgcacggctcgccgcatgcgaaccgatcggcgcatcgcgcgacggcatcgcgcaggaggaggcggcatga

SEQ ID NO: 28 - protein, 540 aa, Burkholderia cepacia ATCC 17616
  DOMAIN (24)...(503): Phenylalanine and histidine ammonia-lyase
MEVRVAEHEMSDVAASAAAAAGRAAVVVGARHLTIEDVVAIARDGAPLALNAAPAWRARIERGAAWLRDHLANGGTVYGVTTGYGDACVVDVPPSLVEALPLQLTRYHGCGMGDWFDATQTLSIVVARLNSLAFGYSGVRFTLLERLADMVNHRILPRIPSEGSVGASGDLTPLSYVAAALVGEGSVGFAGGECDARDAWRAIDRTPLTLAPKEGLALMNGTAVMTGLACLAFARADHLTRMAARLTALTTIALDGRAGHFDARLFDAKPHAGQAEAAAWIRADLAGRDELPGRRLQDRYSVRCAPHVIGVARDALSWMRRDIENELNSANDNPLIDPDEGCVLHGGNFYGGHIAFAMDALKTAVANLADLMDRQLALLVDDKFSNGLPRNLSGAAPERAAINHGFKAVQISSSAWTAEALKHTMPASVFSRSTESHNQDKVSMGTIAARDCLRVLALTEQVAAAHVLATVQAVRLRLRDDPHAQLTPALRAFVDDVGRQSPLVVEDRPLEAELRALCARLAACEPIGASRDGIAQEEAA

SEQ ID NO: 29 - DNA, 1545 bp, Pseudomonas fluorescens PfO-1
atgacaacgccaactcctgagccggtcaccttcggcgaacgccctctgcgcatcgaagacgtgctggctctggccaaccgtcaggcgcccgtgcagttgcagagcgacgcgccttatcgcgaacgcatcgccaagggcgcgcggttcctcgattcgctgctggacaaggaaggtgtgatctacggcgtgaccaccggttacggagactcctgcgtggttgcggtgccgttgcatcacgtcgaggcgctgccgcgtcatctctacacgttccacggttgcgggctgggcaaactgctcgacgcccaggccacccgcgcggtgctggcggcgcgtttgcagtcgttgtgccacggcgtatccggggtgcgcatcgagttgctggaacgcctgcatgccttccttgaacacgacattttgccgctgattcctgaagagggttcggtgggcgccagcggcgacctgacgccgctgtcctacgtcgccgcaaccctgtccggcgagcgtgaagtgatgttccgtggcgaacgccgccaggctgcggacgtgcaccgtgaactgggctggacaccattggtgctgcgtccgaaagaagcgctggcgctgatgaacggcaccgccgtgatgaccggtctggcgtgcctggcttacgcccgcgccgactacctgctgcaactggccacccgcatcactgcgttgaacgtggtggcgctgcaaggcaatccggaacacttcgacgagcgcctgttcgccgccaagccgcatccgggtcagatgcaggtggccgcgtggctgcgcaaggatctggcaatcgacgcgccgaccgcgccgctgcaccgcttgcaggatcgctactcgctgcgctgtgcaccgcacgtgcttggcgtattggccgacagcctgaactggctgcgctcgttcatcgaaaccgaactcaacagcgccaacgacaacccgatcatcgacgccgaagccgagcgcgtgctgcacggcggacacttctacggcgggcatatcgcgttcgccatggacagcctgaaaaacctcgtggccaacgtcgccgacctgctcgaccgacaactcgcgctgctggtcgacgagcgttacaaccacggtttgccgagcaacctgtccggcgccagcgccgaccgcgcgatgctcaaccacggcttcaaggccgtgcaaatcggcgccagtgcctggactgccgaagcgctgaaaaacaccatgccggccagcgtgttctcacgctccaccgagtgccacaaccaggacaaggtgagcatgggcaccatcgccgcccgcgacgccattcgcgtgctggagctgaccgaacaggtcgccgccgccacgttgctcgcggccaatcaaggcgtgtggctgcgcggccgcgatgaagacgctcgcccactgccaccgtcgctggccgccatgcatgaacaactggcccaagacttcccgccagtgatcgaagaccgcgccctggaaggcgaactgcgcctgtgcctgcaacgcatcgccgagcaacactggaggctgcatgcgtag

SEQ ID NO: 30 - protein, 514 aa, Pseudomonas fluorescens PfO-1
  DOMAIN (8)...(486): Phenylalanine and histidine ammonia-lyase
MTTPTPEPVTFGERPLRIEDVLALANRQAPVQLQSDAPYRERIAKGARFLDSLLDKEGVIYGVTTGYGDSCVVAVPLHHVEALPRHLYTFHGCGLGKLLDAQATRAVLAARLQSLCHGVSGVRIELLERLHAFLEHDILPLIPEEGSVGASGDLTPLSYVAATLSGEREVMFRGERRQAADVHRELGWTPLVLRPKEALALMNGTAVMTGLACLAYARADYLLQLATRITALNVVALQGNPEHFDERLFAAKPHPGQMQVAAWLRKDLAIDAPTAPLHRLQDRYSLRCAPHVLGVLADSLNWLRSFIETELNSANDNPIIDAEAERVLHGGHFYGGHIAFAMDSLKNLVANVADLLDRQLALLVDERYNHGLPSNLSGASADRAMLNHGFKAVQIGASAWTAEALKNTMPASVFSRSTECHNQDKVSMGTIAARDAIRVLELTEQVAAATLLAANQGVWLRGRDEDARPLPPSLAAMHEQLAQDFPPVIEDRALEGELRLCLQRIAEQHWRLHA

SEQ ID NO: 31 - DNA, 1548 bp, Idiomarina loihiensis ATCC BAA-735
atgacgacatcgattatagcctttggtggccgcccgttgaccattaaagacgtggtagaaatagccaatggcaaagcgcagatcgcgttaagcgacgcgccggagtttgtcgaaaaagtcgatgccggggttcgttttctggatgagctgttagagcaggacggcgtgatttatggcgtgacaacggggtacggagacagctgcacagtatcggtaccggagaacctggttaacgagttgcccattcatcttacgcgttttcatggttgtggcctgggtgacacctttgatgaacaggaaacccgcgctattctggcaacccgcttaagctcgttggcacaaggttattccggtgtcagctgggagctgttggaacgcctggtggtgatgttgaatgaaaacatgctgccgcttattccaaaagagggcagtgttggtgccagtggtgatcttacgcctttgtcgtacattgccggcgcgcttattggtgagcgtgacgtgcgcttccggaataaagtgatgaacagcgcagaagcctttgagctgcttggtatgtcggttcacaaactgcggccaaaagaaggcctggccattatgaacggtaccgccgtgatgacggctttggcttgccttgcctgggaccgggcggagtacttaacccggttatccagccgcattacctccttggcgagcatagctctggaaggcaacagtaaccattttgatgacctgctgtttgccgtgaaaccccataaagggcagcaacaggtcgccagctggatccaacaagatctgaaccatgtggagcatccgaggaattcatcgcgtctgcaggaccggtactccatccgctgcgcgcctcatgttatcggcgtacttaaagacagtttaccgtggtttaaagaaaccatagaaaatgaattaaacagcgccaatgacaaccccattattgatggcttaggtgagcatgttctgcacggcgggcacttctacggcggccacattgctatggtgatggactcgatgaaaactgctgtggcgaacctggcggatttacacgaccggcaaatggcgttgttgatggacacaaagatgaaccacggtttgccctcgaacttgtctgcggcagaaggtgagcgtaagtctattaaccacggctttaaagcggtgcagattggttgctcagcctggactgcggaagcattaaaactgactatgccagccagtgtcttttcgcgctcaaccgagtgtcataaccaggacaaagtgagcatgggtactattgctgcccgtgactgtattcgtattctggaactgaccgaacaggtggttgttgccactttgctggcagcttatcaaggtgttgaactgcgtaagcgtattacagacaaaccggtgaacccatcggccggtgtcttagaaatgcttcgaagtctggctgatcagtttgaactgctgacagaagaccgccagttggagccggaattacgttattggcttacccagttgcggttaaaagtatggaatttgtatcaggagccagcatga

SEQ ID NO: 32 - protein, 515 aa, Idiomarina loihiensis ATCC BAA-735
  DOMAIN (5)...(481): Phenylalanine and histidine ammonia-lyase
MTTSIIAFGGRPLTIKDVVEIANGKAQIALSDAPEFVEKVDAGVRFLDELLEQDGVIYGVTTGYGDSCTVSVPENLVNELPIHLTRFHGCGLGDTFDEQETRAILATRLSSLAQGYSGVSWELLERLVVMLNENMLPLIPKEGSVGASGDLTPLSYIAGALIGERDVRFRNKVMNSAEAFELLGMSVHKLRPKEGLAIMNGTAVMTALACLAWDRAEYLTRLSSRITSLASIALEGNSNHFDDLLFAVKPHKGQQQVASWIQQDLNHVEHPRNSSRLQDRYSIRCAPHVIGVLKDSLPWFKETIENELNSANDNPIIDGLGEHVLHGGHFYGGHIAMVMDSMKTAVANLADLHDRQMALLMDTKMNHGLPSNLSAAEGERKSINHGFKAVQIGCSAWTAEALKLTMPASVFSRSTECHNQDKVSMGTIAARDCIRILELTEQVVVATLLAAYQGVELRKRITDKPVNPSAGVLEMLRSLADQFELLTEDRQLEPELRYWLTQLRLKVWNLYQEPA

SEQ ID NO: 33 - DNA, 1527 bp, Fibrobacter succinogenes ATCC 19169
atgaaaaccgtcgttattggaagtggtaagctttcgattgaagatgttgttgcgattgcgaaaaagcaagtcgcagtggaacttgatagttctgcggaattccagagaaagattgattctggtgcagaattcttggacgaagcgcttgcagaacatggtggcatttatggcgtgacaacgggatatggtgattcctgcacgcaggtgttgccgccggaacattacagccagctcccgattaacttgacgcgtttccatggatgcggcctcggtgattactttgatgccgagacgacccgcgcgattatggcggtacgcttgaatacgcttgcgcaaggtttctctggtgtgagctatgcacttttgaaaatcattacgcagtttttacagaacgatattttaccgctcattccgcaggaaggttccgtgggcgcaagtggcgacttgactccgctttcgtatttggcaggtgccgtgattggtgaacgcaatgtgatgtacaagggcgaacgtcgttcttctttggacgtgatgaaggaattgggaattactccgcacaagtttcgcccgaaagaagcaattgccattatgaacggcacggcggcgatgaatgcggtcgcttgcatggcttattcccgtgcagaatacctttctgacctcgcttgccgaattacagcgatgattacggttgcaatgaagggcaatgcgtatcactattatgaacgcttgttcgaagcaaaaccgcatccgggacttggcttggctgcaaagaaaattcgtgaagccttgaatctcgatgtggcgaagaatgtggttcccgagaaaatccaggatccgtattctctgcgttgcgctccgcatgtgattggacttttctatgattctagcgcgttcttgcgccaattgattgaaattgaactcaacagcgctaatgacaatccgattgtcgatccgttcacaaagaatattttccacggtgggcatttctatggcgggcatatttgccttgcgatggatacgctcaagaacatggttgcaaacattgcggaccttttggaccgtcagctggcgatgattgtcgatatcaagttcaaccgtaacttgccaccgaatcttgcggggagcaagggcgattacgatatcaatcatggctttaaggcggtgcagataggcgtttctgcatggacggctgaagctttgcatttgacaatgccgatgagcgtgttcagccgttcgacggaatgccacaaccaagacaaggtcagcatgggtacgattgcggcccgcgactgcatccgcgtcttggagctttcggaacaggtggcagcggcaacgcttctggcttcggctcaggcacttcgcatacgcttggaacgcaatgaaatttcggaagaccgcctcaagaatcttcaagagacttacaatcaggtattctcgaagtttgctccgcttgaatgtgaccgtcaattggaacaggatttgcgcaatacgctggagctgattcgccagaaattttacgctgtataa

SEQ ID NO: 34 - protein, 508 aa, Fibrobacter succinogenes ATCC 19169
  DOMAIN (3)...(483): Phenylalanine and histidine ammonia-lyase
MKTVVIGSGKLSIEDVVAIAKKQVAVELDSSAEFQRKIDSGAEFLDEALAEHGGIYGVTTGYGDSCTQVLPPEHYSQLPINLTRFHGCGLGDYFDAETTRAIMAVRLNTLAQGFSGVSYALLKIITQFLQNDILPLIPQEGSVGASGDLTPLSYLAGAVIGERNVMYKGERRSSLDVMKELGITPHKFRPKEAIAIMNGTAAMNAVACMAYSRAEYLSDLACRITAMITVAMKGNAYHYYERLFEAKPHPGLGLAAKKIREALNLDVAKNVVPEKIQDPYSLRCAPHVIGLFYDSSAFLRQLIEIELNSANDNPIVDPFTKNIFHGGHFYGGHICLAMDTLKNMVANIADLLDRQLAMIVDIKFNRNLPPNLAGSKGDYDINHGFKAVQIGVSAWTAEALHLTMPMSVFSRSTECHNQDKVSMGTIAARDCIRVLELSEQVAAATLLASAQALRIRLERNEISEDRLKNLQETYNQVFSKFAPLECDRQLEQDLRNTLELIRQKFYAV

SEQ ID NO: 35 - DNA, 1554 bp, Vibrio parahaemolyticus ATCC 17802
atgacaaacaacaataatcacaacatcacttttggtgcccaatctttaaccatcgaagatgtcgttgccattgctcaaggtgcaaaggcaaacatgaacacctcgccagaatttaccgcgaaaattgatcgtggcgtggcgtttctggaacgattactgaaagaagaaggcgttatttacggcgtgactacgggttacggcgattcatgtactgtggcgattccacccgctcttgtggatgaacttccgttgcaccttacgcgcttccatggctgtggcttaggtcaaatcctttctcatgagcaagctcgcgcggtgttggcaacccgtttatgttcattgtcgcaaggcgtatctggcgtgtctcacgatctgttgaaccaaatcgttacgcttatcaaccacgacattgcgccgcgtattccacaagagggctcggtgggcgcaagtggcgatttaacgcctctgtcttacctagcggcgaccttaattggcgagcgtgaagtgctttacaaaggcgatgtgcgaccaacacaagaagtgtttgcagagctggacattgagccaattcgcctaaaaccaaaagaaggtttggcgttaatgaacggtacatccgtgatgactgccctcgcctgtcttgcctacaaacgcgcagaatacctagcgcagctttgcaccaagattaccgcgatggtctctgtgggtatgcaaggtaatgacttccactttgatgaagcgttgtttgcggtaaaacctcaccctggtcaacagcaagttgcggcttggctgcgtgatgatctcaatgctgaacgtccgccacgcaatagcgaccgactgcaagatcgttactcactgcgttgtgcgccacacgtgattggcatggtgcaagactccctgccttggctacgtcaattgattgagaatgaactaaatagtgccaacgacaatccaattatcgatggtgacaacgagcgcgttctgcacggcggtcacttctacggtggtcatatcgcaatggcgatggatacgttgaaagtgaacattgccaacttagctgatttgctggaccgtcagatggcgcaactgatggattacaagttcaataacggcctgccgtttaacttaaccggtgcagaaggcgaacgtaaaccgatcaaccacggctttaaagcggttcagattggtatctcagcttggacggcagaagcgttgaaaaacaccatgccagcgagcgttttttctcgctcaaccgaatgtcacaaccaagacaaagtgagcatgggcaccattgcggctcgtgattgcctacgcgtacttgagttaacagagcaagttgctgcggcttcactcctagcaagcgttcaagcggttgagattcgtcgccgtcataacgaattggacgaacaccacatgagtcagagtttgcgagtaattcgtgacgccgtactgagcgagtttaagtttgtgattgaagatcgcccgttagaacaagatttgcgtcatttcattgaacgcattcagcaacgtcattggccactctacgcggaggtataa

SEQ ID NO: 36 - protein, 517 aa, Vibrio parahaemolyticus ATCC 17802
  DOMAIN (8)...(487): Phenylalanine and histidine ammonia-lyase
MTNNNNHNITFGAQSLTIEDVVAIAQGAKANMNTSPEFTAKIDRGVAFLERLLKEEGVIYGVTTGYGDSCTVAIPPALVDELPLHLTRFHGCGLGQILSHEQARAVLATRLCSLSQGVSGVSHDLLNQIVTLINHDIAPRIPQEGSVGASGDLTPLSYLAATLIGEREVLYKGDVRPTQEVFAELDIEPIRLKPKEGLALMNGTSVMTALACLAYKRAEYLAQLCTKITAMVSVGMQGNDFHFDEALFAVKPHPGQQQVAAWLRDDLNAERPPRNSDRLQDRYSLRCAPHVIGMVQDSLPWLRQLIENELNSANDNPIIDGDNERVLHGGHFYGGHIAMAMDTLKVNIANLADLLDRQMAQLMDYKFNNGLPFNLTGAEGERKPINHGFKAVQIGISAWTAEALKNTMPASVFSRSTECHNQDKVSMGTIAARDCLRVLELTEQVAAASLLASVQAVEIRRRHNELDEHHMSQSLRVIRDAVLSEFKFVIEDRPLEQDLRHFIERIQQRHWPLYAEV

SEQ ID NO: 37 - DNA, 1599 bp, Photorhabdus luminescens ATCC29999
atgaaagctaaagatgttcagccaaccattattattaataaaaatggccttatctctttggaagatatctacgacattgcgatgaaacaaaaaaaagtagagatatcaacggagatcactgaacttttgacgtatggtcgtgaaaaattggaggaaaaattaaattcaggagaggttatatatggaatcaataccggatttggggggaatgccaatttagttgtaccatttgaaaagatttcagagcatcagcaaaatctgttaacttttctttctgctggtactggggactatatgtccgaaccttgtattaaagcgtcacaatttactatgttactttctgtttgcaaaggttggtctgcaaccagaccaattgtcgctcaggcaattgttgatcatattaatcatgatattgttcctctggttcctcgctatggctcggtgggggcaagcggcgatttaattcctttatcttatatcgcacgcgcattatgtggtatcggcaaagtttattacatgggggcagaagttgacgctgctgaagcaattaaacgtgcaggattgacgccgctatcgttacaagcaaaagaaggtctcgctctgattaacggcacacgggttatgtcaggtatcagtgcaattaccgtcattaaactggaaaaactatttaaagcctcaatctctgctattgccctcgctgttgaagcattacttgcatctcatgaacattatgatgcccggattcaacaagtaaaaaatcaccctgggcaaaaagcggtggcaagtgcattgcgtaatttattagcaggctcaactcaagttaatttattaactggaattaaagaacaagctaataaagcttgtcgccatcaagaaattacccggctaaatgataccttacaggaagtttattccattcgttgtgcgccacagatattaggtatagtgccggaatctttagctaccgcacggaaaatattggagcgggaagttatctcagctaatgataatccattgatagatccagaaaatggcgatgttctgcacggtgggaattttatgggacaatatgttgcccggacaatggatgcattaaaactggatattgctttaatcgccaatcatcttcatgccattgtggcactgatgatggataaccgtttctctcgtggattacctaattcactgagtccgacacccggcatgtatcaaggttttaaaggcgtccaactttctcaaaccgctttagttgctgcaattcgccatgattgtgctgcatcaggtattcataccctcgccacagaacaatacaatcaagatattgtcagtttaggtctgcatgccgctcaagatgtgttagaaatggagcagaaattacgccatattgtttcaatgacaattctggtcgtttgtcaggccactcatctgcgcggcaatattagcgaaatcgcgcctgaaaccgctaaattttaccatgcagtacgagaaatcagtcctcctttgatcgctgatcgtgcattagatgaagatataattcgcattgcggatgcaattattaatgatcaacttcctctgccagaaatcatgctggaagaataa

SEQ ID NO: 38 - protein, 532 aa, Photorhabdus luminescens ATCC29999
  DOMAIN (11)...(503): Phenylalanine and histidine ammonia-lyase
MKAKDVQPTIIINKNGLISLEDIYDIAMKQKKVEISTEITELLTYGREKLEEKLNSGEVIYGINTGFGGNANLVVPFEKISEHQQNLLTFLSAGTGDYMSEPCIKASQFTMLLSVCKGWSATRPIVAQAIVDHINHDIVPLVPRYGSVGASGDLIPLSYIARALCGIGKVYYMGAEVDAAEAIKRAGLTPLSLQAKEGLALINGTRVMSGISAITVIKLEKLFKASISAIALAVEALLASHEHYDARIQQVKNHPGQKAVASALRNLLAGSTQVNLLTGIKEQANKACRHQEITRLNDTLQEVYSIRCAPQILGIVPESLATARKILEREVISANDNPLIDPENGDVLHGGNFMGQYVARTMDALKLDIALIANHLHAIVALMMDNRFSRGLPNSLSPTPGMYQGFKGVQLSQTALVAAIRHDCAASGIHTLATEQYNQDIVSLGLHAAQDVLEMEQKLRHIVSMTILVVCQATHLRGNISEIAPETAKFYHAVREISPPLIADRALDEDIIRIADAIINDQLPLPEIMLEE

SEQ ID NO: 39 - DNA, 1710 bp, Nostoc punctiforme strain ATCC 29133
atgaatataacatctctacaacagaacataacgcgttcttggcaaatacctttcactaatagttcagattcaatcgtaactgtaggcgatcgcaatctgacaatcgacgaggttgtaaatgttgctcgtcatggaacacaggtgcgcttaactgataatgcagatgtcattcggggtgttcaagcatcttgtgattacattaacaatgcagtcgaaacagcacagccaatttacggggtgacatctggctttggcggtatggcagatgttgtcatctctcgcgaacaagcagcggaacttcagactaatttaatttggtttctgaaatccggcgcaggaaacaaattatcgttagcagacgtgcgtgcagctatgctcttacgtgcaaattcacatttgtatggtgcgtctggtatacgactcgaacttattcagcggattgaaactttcctcaacgctggcgtgacaccccatgtctatgagtttggctctatcggtgctagcggcgatttggtgccattatcctacattactggggcactaatcggtctagatcctagctttacagttgacttcgacggtaaagaaatggatgccgttacagccttgtctcgtttgggtttgccaaagttgcaattgcaaccgaaagaaggtttagcaatgatgaatggcacctcagtcatgacaggtattgcagctaactgtgtgtacgatgcgaaagttttgctcgctctgacaatgggtgtacacgccttagccatccaaggtttatacggaacgaatcaatctttccacccgtttattcatcagtgcaagccacatcccggtcaactatggacagcagatcaaatgttttctctgctgaaagattcatctttagttcgtgaagagttggatggtaaacacgaataccgtggtaaagatctgatacaggatcgttattctctccgctgtctggcacagttcatagggccaatcgttgatggggtatcagagattaccaagcaaatcgaggtagaaatgaactcagtcaccgataacccattgattgatgtcgagaaccaagttagttatcacggcggcaattttctcggacagtatgtgggtgtgacaatggatcgcctacgttattacatagggctattggccaaacacatcgatgtgcagattgcacttcttgtctcgccagagtttagcaacggcttaccaccctctttagttggtaatagcgatcgcaaagttaatatgggactcaaaggtttgcaaatcagtggaaactcgattatgccactgttgagcttctatggaaattccctagccgatcgctttcctacccacgccgagcaatttaatcaaaatattaacagccaaggctatatttccgcaaatttgacacgtcgttccgtagacatatttcagaattatatggcgatcgcgttgatgtttggagttcaagctgttgacctccgcacatataagatgaaaggtcattatgatgcacgtacatgcctctcacccaatactgtgcagttatacacagcagtctgcgaggtagttggaaagccactaacgtctgtgcgtccatacatttggaacgacaacgagcaatgtttagatgagcatattgcccggatttcagctgatatcgctggtggtggtttaattgtgcaagcagttgagcatattttttcgagcttaaagtcaacgtaa

SEQ ID NO: 40 - protein, 569 aa, Nostoc punctiforme strain ATCC 29133
  DOMAIN (25)...(524): Phenylalanine and histidine ammonia-lyase
MNITSLQQNITRSWQIPFTNSSDSIVTVGDRNLTIDEVVNVARHGTQVRLTDNADVIRGVQASCDYINNAVETAQPIYGVTSGFGGMADVVISREQAAELQTNLIWFLKSGAGNKLSLADVRAAMLLRANSHLYGASGIRLELIQRIETFLNAGVTPHVYEFGSIGASGDLVPLSYITGALIGLDPSFTVDFDGKEMDAVTALSRLGLPKLQLQPKEGLAMMNGTSVMTGIAANCVYDAKVLLALTMGVHALAIQGLYGTNQSFHPFIHQCKPHPGQLWTADQMFSLLKDSSLVREELDGKHEYRGKDLIQDRYSLRCLAQFIGPIVDGVSEITKQIEVEMNSVTDNPLIDVENQVSYHGGNFLGQYVGVTMDRLRYYIGLLAKHIDVQIALLVSPEFSNGLPPSLVGNSDRKVNMGLKGLQISGNSIMPLLSFYGNSLADRFPTHAEQFNQNINSQGYISANLTRRSVDIFQNYMAIALMFGVQAVDLRTYKMKGHYDARTCLSPNTVQLYTAVCEVVGKPLTSVRPYIWNDNEQCLDEHIARISADIAGGGLIVQAVEHIFSSLKST

SEQ ID NO: 41 - DNA, 1638 bp, Streptomyces avermitilis ATCC 55292
atgtcgtctcggatcgtggatacgtcgaccgtggaagtgagccccgcgtcgaccgggatcgtggtcctcgacggctgtggaatcggcgtctccgacgtcgtgtgcctcgccgacggggcttcgcggccggttcccggcaccgaagcgatgaagcgggtggaggagtcctgggacgcggcccggcagatcgccgcgaccggccgggtctacggccgctccaccggagtgggcgcgaaccggaacgaggacgtgcccacggaggcggccgcggggcacggactccggctgctgcgcagccatgccggggccatcggggcggagctgcccgcgcggcaggtgcgggcgatgctggccgtgcgggtcaaccagttgctggccggcggcgcggggctgcggcccaccgtggtcacggcgctgtgcgaggcgctggagaacggggcctaccccgtcgtgaacgagttcggctcggtgggcacgggcgacatcgcggccctggcccaggtgggactggcgctcgcgggggagcatccgtggcgacgggcggagacttccggggggttggggtcggagacttccggtgggccgggggcaggggcttcgggtgggcggtacgcgggaggcgtgcgcgctcttcggcggggcgcgtccgcgcgggagatcggcgctccggagccccagctcctcgacaacaacgacgccctcgcgctcatcagcagcaacgccctcaccctcggccagtccgcgctcgcgctgcacgagctgcgcgggctcatcggcgccacccaggtcgtcgcggcgctctcgctgctcgcggtcgacggctcgcacgaggcgtacgccgcccccgtgcacaccgcccgcccgcaccgcggctccgccgaagtcgcccggatcatgcgggagttgatcggcgccgccgaccggccgaccccgcccctcggccgtatccaggacccgtacggcttccgctgtctgccccagatccacggccccgcacacgaggcggccgacgcgctcgaagcggtcctcgcggtcgagatcaacgccgccgccgagaaccccctcatctcccccggggacctggccgcctaccaccacggcggcttctaccaggcccaactcgccctggccctcgaccacttcaggctggccatcacccaggtggcgcgcctgtcgacgtccaggctgtcgacgttgaacgagcccgcgtacacccggctgcgccccttcctcgccgaccacgagcccgcctcctccggcgtgatgatcctggagtacgccgccggagccgccctcggcgatctgcgcgcgttctccgcgcccgcctcgctcgggcacgctgtactctcccggggcgtcgaggaacaggccagcttcgcctcgctcgcggcacgccagacgctgcgggcgtgcgacgcgtaccgtctcgtcgtcggctgtgaactggtcgccgccgtacgggcgctgcgccagcgcgacctgcggcccgacccggagctgccggtgggccgggcgctggagctcgccgagtcggtgctcgacccggagccggccgaccggccgctcacggacgacgtgacggccgcggccgcactgctcgaccggttcacggagatctggagggggagcgagtcatga

SEQ ID NO: 42 - protein, 545 aa, Streptomyces avermitilis ATCC 55292
  DOMAIN (20)...(518): Phenylalanine and histidine ammonia-lyase
MSSRIVDTSTVEVSPASTGIVVLDGCGIGVSDVVCLADGASRPVPGTEAMKRVEESWDAARQIAATGRVYGRSTGVGANRNEDVPTEAAAGHGLRLLRSHAGAIGAELPARQVRAMLAVRVNQLLAGGAGLRPTVVTALCEALENGAYPVVNEFGSVGTGDIAALAQVGLALAGEHPWRRAETSGGLGSETSGGPGAGASGGRYAGGVRALRRGASAREIGAPEPQLLDNNDALALISSNALTLGQSALALHELRGLIGATQVVAALSLLAVDGSHEAYAAPVHTARPHRGSAEVARIMRELIGAADRPTPPLGRIQDPYGFRCLPQIHGPAHEAADALEAVLAVEINAAAENPLISPGDLAAYHHGGFYQAQLALALDHFRLAITQVARLSTSRLSTLNEPAYTRLRPFLADHEPASSGVMILEYAAGAALGDLRAFSAPASLGHAVLSRGVEEQASFASLAARQTLRACDAYRLVVGCELVAAVRALRQRDLRPDPELPVGRALELAESVLDPEPADRPLTDDVTAAAALLDRFTEIWRGSES

SEQ ID NO: 43 - DNA, 1587 bp, Ralstonia solanacearum ATCC 11696
atggctgaacacgatctgatgccggccgcagtcgcccggccgctcccggcgccgatcctcttcggcgcccaccacctgtccatcgaagccgtcgtcgccatcgcgcggcggcaggcaacggtcgccctgaacagtgacgcagcatggcgggatcgcatcgaccgcggtgcccgcttcctgcaggagcagttggcgcagggcgcaacggtctatggcgtcaataccggatacggcgacgcctgcgaggtcggcgtgccgccgtcgctggtcgcggcgctgccgctgcagctcacgcgctaccacggctgcgggatgggccgctacctggacccgtcggaaacgctggccgtcatcgcggcacggctgaactcgctggcccatggctattcgggcgtgcgccatgcgctgctgcagcgcctggccgacctgatcaaccacgacatcctgccgcgcattccggcggagggctcggtgggtgccagcggcgacctgacaccgctgtcctatgtcgcggcggcgctggtgggcgagcgcgacgttgtgttcgacggcaaggtgcaggccgcgagcgatgtgtggcgggcgctggggcatgccccgttcgaactggcgcccaaggaagggctggcgctgatgaacggcacggcggtgatgaccggtctggcctgcctggcctacgcccgcgccgcgcacctgatccgcctgtcgacccggctgacggcactggccacggtcgcgctcgatggccgctccgggcacttcgatgcgacgatcttccaggccaagccccatgccgggcaagcagatgtcgccgcgtggctgcgcgcagacctggccggctgggacgacacgggcggacaccggctgcaggaccgctactcgatccgctgcgcgccgcacgtgatcggggtggcgcgcgacgcgatgtcctggatccggcgcgatatcgaaaacgagctcaacagcgcgaacgacaatccgctcgtcgatccggatgcccggcgcatcctgcatggcggcaacttctatggcggccatatcgcctttgcgatggatgccctgaagaccgccgtcgccaacctggccgacctgatggaccgccagcttgcgctgctcgtggacgaccgatacagcaacggactgccgcgcggcctgtccggcgcgcccccggagcgggcccccatcaaccatgggttcaaggcgatccagatctcggtctccgcctggaccgcggaggcgctcaagcacaccatgcccgccagcgtgttctcccgctcgacggaatcgcacaaccaggacaaggtcagcatgggtacgatcgccgcgcgcgactgcctgcgcgtgctcgaactgaccgagcaggtcgcggcggcccacacgctggccacggcgcaggcggtgcggctgcgtgccgggctcgacgccacgctggcgattccgcccgcggtgcaggcctttgtcgagcgcgtcacggcactgtccgaggcggtgaccgaagaccggccgctcgaaacggacctgcgccgcctgacggcgtgcatcgagcacggctcgctcatggcgggcgaacccggagggcaatcatga

SEQ ID NO: 44 - protein, 528 aa, Ralstonia solanacearum ATCC 11696
  DOMAIN (20)...(495): Phenylalanine and histidine ammonia-lyase
MAEHDLMPAAVARPLPAPILFGAHHLSIEAVVAIARRQATVALNSDAAWRDRIDRGARFLQEQLAQGATVYGVNTGYGDACEVGVPPSLVAALPLQLTRYHGCGMGRYLDPSETLAVIAARLNSLAHGYSGVRHALLQRLADLINHDILPRIPAEGSVGASGDLTPLSYVAAALVGERDVVFDGKVQAASDVWRALGHAPFELAPKEGLALMNGTAVMTGLACLAYARAAHLIRLSTRLTALATVALDGRSGHFDATIFQAKPHAGQADVAAWLRADLAGWDDTGGHRLQDRYSIRCAPHVIGVARDAMSWIRRDIENELNSANDNPLVDPDARRILHGGNFYGGHIAFAMDALKTAVANLADLMDRQLALLVDDRYSNGLPRGLSGAPPERAPINHGFKAIQISVSAWTAEALKHTMPASVFSRSTESHNQDKVSMGTIAARDCLRVLELTEQVAAAHTLATAQAVRLRAGLDATLAIPPAVQAFVERVTALSEAVTEDRPLETDLRRLTACIEHGSLMAGEPGGQS

SEQ ID NO: 45 - DNA, 1548 bp, Pseudomonas syringae pv. Tomato ATCC BAA-871
atgacgaatcaagttcctgacccgatcatgttcggcgaacgcgccctgtgtatcgaagacgtgctggccctggccaatcgtcaggcaccgagcgcgctgcaaggcgacgatgaatttcgcgcacgcatcgccaggggcgcgcagtttctcgattcgttgctgagcaaggaaggcgtgatctacggggtcaccaccggttacggggattcctgcgtggtggcggtgccgctggagcatgtcgaggcgctaccgcgttatctgtacacgtttcacggttgcgggctgggcaaactgctcgacgcccaggccacccgcgcagtgttggcggcgcgcttgcagtcgttgtgtcagggcgtttccggggtgcgggtcgaactgctcgagcgtttgcaggcatttatcgatcaggacgtgctgccgttgatccccgaagaaggctcggtgggtgccagtggtgatctgacgccgctgtcgtacgtggccgcgaccctgtccggtgagcgcgaggtgatgttccgtggcgagcgccgtttggccagcgatgtgcatcgcgaactgggctggacgccgctggtgctgcgccccaaggaagcactggcgctgatgaacggcaccgctgtcatgaccggcatcgcctgcctggccttcgcccgcgccgattacctgctgcaactggccacccgcatcaccgcgatgaatgtggtggcgctgcaaggcaacccggaacacttcgacgagcgcctgtttgccgccaagccgcacccgggccagatgcaagtggcggcgtggctgcgtcaggacctggccatcgacgcgccaaccgctccgctgcaccgtttgcaggatcgctattcgctgcgttgcgcaccgcatgtgctgggcgtgctggccgacagcctgaactggctgcgttcgttcatcgagatcgagctgaacagcgccaatgacaaccctattatcgatgcagaagccgagcgcgtgttgcacggcgggcatttttacggcgggcatatcgcctttgcaatggacagcctgaaaaccctggtggccaacgtcgcggacttgctcgaccggcaactggcgctgttggtggacgagcgctacaaccacggcttgccgagcaacctgtcgggtgccagcgccgagcgggcgatgctcaatcatggcttcaaggcagtgcagatcggcaccagcgcgtggaccgccgaagcgctgaaaaacaccatgccggccagtgtgttctcacgttccaccgaatgccacaatcaggacaaggtgagcatgggcacaatcgctgcgcgtgacgccattcgtgtgctggagctgaccgaacaggtcgccgcggccacgctgatcgccgccaatcagggtgtctggctgcgcagcaagggcgccgatgcgcgcccgctgccaccggcgctggccagcatgcacgcagaactgggcgaagactttgctccggtcatcgaagaccgtgcactggaaagcgaactgcgtctgtgcctgaaacacatcgccaaccgccgctggaggttgcatgcgcagtaa

SEQ ID NO: 46 - protein, 515 aa, Pseudomonas syringae pv. Tomato ATCC BAA-871
  DOMAIN (8)...(486): Phenylalanine and histidine ammonia-lyase
MTNQVPDPIMFGERALCIEDVLALANRQAPSALQGDDEFRARIARGAQFLDSLLSKEGVIYGVTTGYGDSCVVAVPLEHVEALPRYLYTFHGCGLGKLLDAQATRAVLAARLQSLCQGVSGVRVELLERLQAFIDQDVLPLIPEEGSVGASGDLTPLSYVAATLSGEREVMFRGERRLASDVHRELGWTPLVLRPKEALALMNGTAVMTGIACLAFARADYLLQLATRITAMNVVALQGNPEHFDERLFAAKPHPGQMQVAAWLRQDLAIDAPTAPLHRLQDRYSLRCAPHVLGVLADSLNWLRSFIEIELNSANDNPIIDAEAERVLHGGHFYGGHIAFAMDSLKTLVANVADLLDRQLALLVDERYNHGLPSNLSGASAERAMLNHGFKAVQIGTSAWTAEALKNTMPASVFSRSTECHNQDKVSMGTIAARDAIRVLELTEQVAAATLIAANQGVWLRSKGADARPLPPALASMHAELGEDFAPVIEDRALESELRLCLKHIANRRWRLHAQ

SEQ ID NO: 47 - DNA, 1566 bp, Shewanella oneidensis ATCC 700550
atgagccacgtagttactcaaacgacaaccgttgagtcgccaatcgaatttggccgtcagttactcacattagagcaggtcgtcgccgtggctaagggcgcaaaggtcaaactctgtgatgatgccgattatcaagaatatatccaaaagggcgcccgctttatcgatagtttgctgcacgaagaaggcgtggtctacggcgtcaccacaggctatggcgactcttgcacagtgaatgtgagtcttgacttggtccacgagttgccgctgcacttatcccgttttcatggttgtggccttggtgaagtcttaagcgtaatgcaagcgcgcgccgtgatggcttgccgtttaaactccctcgccattggcaaatccggcgtgacatatgagctattaaagcgcatccaaaccttgcttaatctcaatatcgtgccagtgatccccgaagaaggctcagtcggtgccagcggagacttaacgccactgtcttaccttgccgccgtgctggttggtgagcgtgaggtgatttaccaaggcgagcgccgagccaccaaagaggtttatcacgagctgaatatcacgccccatgtgctacgtcccaaggaaggtttagccctgatgaacggcacggcagtgatgacagcgttagcctgtttagcctttgatcgcgcacaatatttagcgcgtttagccagccgcattaccgccatggcgtcgttaacccttaaaggcaactccaaccatttcgacgatattctgtttgccgccaaacctcatccagggcaaaaccaaatcgccacttggatacgggaagacttgaaccaccatgttcacccgcgcaattccgacagattgcaggacagatattccatccgctgtgcgccgcatattattggcgtgctgcaggatgcgctgccctttatgcgccaatttatcgaaaccgaagttaacagcgccaacgacaacccgattgtcgatgctgaaggcgagcatattctccatggcggccatttttacggcgggcatatcgcctttgcgatggactccttaaaaaatattgtggccaatatcgccgatctgattgatcgccaaatggcattagtgatggaccctaaatttaacaacggcttacccgctaacctttcgggttcaaccgggccacgccgcgccatcaaccatggctttaaggcggtgcaaatcggcgtttcagcctggacggcagaagcactgaaacacactatgcccgcaagcgttttctcacgctcaaccgaatgccacaaccaagataaagtcagcatgggcaccattgccgcccgcgactgtatgcgtgtattgcaactaacggaacaagtcgccgccgcggcgctacttgctatgactcaaggcattgatctgcgtatcacacaaaacgagttagacgaagcctcactgacgccatcactggcgaccacgctcgcccaagtgcgcgctgactttgagccattagtcgaagacagaccgctcgaagccgtgctacgccaaaccgtcgctaaaatccaagccggtgaatgggaagtgtgccgatga

SEQ ID NO: 48 - protein, 521 aa, Shewanella oneidensis ATCC 700550
  DOMAIN (14)...(497): Phenylalanine and histidine ammonia-lyase
MSHVVTQTTTVESPIEFGRQLLTLEQVVAVAKGAKVKLCDDADYQEYIQKGARFIDSLLHEEGVVYGVTTGYGDSCTVNVSLDLVHELPLHLSRFHGCGLGEVLSVMQARAVMACRLNSLAIGKSGVTYELLKRIQTLLNLNIVPVIPEEGSVGASGDLTPLSYLAAVLVGEREVIYQGERRATKEVYHELNITPHVLRPKEGLALMNGTAVMTALACLAFDRAQYLARLASRITAMASLTLKGNSNHFDDILFAAKPHPGQNQIATWIREDLNHHVHPRNSDRLQDRYSIRCAPHIIGVLQDALPFMRQFIETEVNSANDNPIVDAEGEHILHGGHFYGGHIAFAMDSLKNIVANIADLIDRQMALVMDPKFNNGLPANLSGSTGPRRAINHGFKAVQIGVSAWTAEALKHTMPASVFSRSTECHNQDKVSMGTIAARDCMRVLQLTEQVAAAALLAMTQGIDLRITQNELDEASLTPSLATTLAQVRADFEPLVEDRPLEAVLRQTVAKIQAGEWEVCR

SEQ ID NO: 49 - DNA, 1632 bp, Unknown
  Obtained from environmental sample
atgaaaaaactggtactacacggcgactgcctaaccttacaagatctggtacgcttttcgcgacgcctaggtcccccagccatcctggaaatcgccccagaagctgagataaaagttaccgaagctgccaagtggattgaaggccaggtaaaaagtggccgggccatctacggggtcaccacgggttttggctccaaccaggacaaaatcatcgacccggaagacgcggaaactctgcaaaaaaatcttattatctcccatgccgtgggttttggcccagacctggaagaagatattgtgcggggagccatcgtgctgagagtcaacaccctgcttaagggccactctggtatcaccgcggaaactgtacagtttttcatagacatgctcaacgaccacgtatatcctgccgtgcctgccaaaggaagcctgggagcaagcggtgacttagcccccttaagccatatggtgctgcccctgctgggccgaggccatgtgtaccggcgaggcgtaaaaatgacctccatgcaatggcttgacgactctggccacaagccccagaccctcacctataaagaaggcctcgccctaaacaacggcactccggtcatgaccgctgtgggcgcttttgccctgtacgatgccaaaaaactgcttcaatacgccaccatgagcgctgcccttacttgcgaagccttgcttgctcgcagcagtttcctgcacccgaaagtgcatcgcctgcgcacggccccaaaagtaaaaggccaggaaaaagcagccggacgtttgcgccagtttttcaaagattccaagctaatcgactaccccttccccgactccagcaaagaaaacgacaacgcaccctacccgacaggccgccgggaaatcgtacaaaatgcctactcggtgcgctgcattccccaggttcacggggctgcttcaaatgcaatagagcatgtcactgatgtggtggaaatggagctcaatgccgtaactgacaacccgctgatttttgtagacagcgacgaggtggtaagtgctggcaacttccacggcgaacccttagccctgcctttagaatacctaaaaatagctgtggcagagcttggcagcattgccgagcgacggctgtacaagcttaccgaccagcacttgaacgagggcctgcctgcctacttaagccagggaaaaccaggacttaactccggtgtcatgattgtccagtacgtggcggcaagcctagttgcagaaaataaagtgctatgccaccccgcagccgtagacagcatccccaccagcgaaaactttgaagaccacgtttccatgggtagcctctctgcctaccacgccctccaggtggcagaaaacgtccatcgcattattgccagcgagctgtttgccgctttccaggctgtgagcatccggctgcgacaacttggctacgacgaagacgactacagccccttgggccagggatcggctgcggttatgcaatgcatctcagaggcaggcattaagccctatgtaggtgatgagtggttctatgagcagcttaacgtgatgagcaacttgcttaaaggcgaaaaacttttgcaggcagttgacgaagcagtaggcccctgtaaagactag

SEQ ID NO: 50 - protein, 543 aa, Unknown
  Obtained from environmental sample
  DOMAIN (3)...(498): Phenylalanine and histidine ammonia-lyase
MKKLVLHGDCLTLQDLVRFSRRLGPPAILEIAPEAEIKVTEAAKWIEGQVKSGRAIYGVTTGFGSNQDKIIDPEDAETLQKNLIISHAVGFGPDLEEDIVRGAIVLRVNTLLKGHSGITAETVQFFIDMLNDHVYPAVPAKGSLGASGDLAPLSHMVLPLLGRGHVYRRGVKMTSMQWLDDSGHKPQTLTYKEGLALNNGTPVMTAVGAFALYDAKKLLQYATMSAALTCEALLARSSFLHPKVHRLRTAPKVKGQEKAAGRLRQFFKDSKLIDYPFPDSSKENDNAPYPTGRREIVQNAYSVRCIPQVHGAASNAIEHVTDVVEMELNAVTDNPLIFVDSDEVVSAGNFHGEPLALPLEYLKIAVAELGSIAERRLYKLTDQHLNEGLPAYLSQGKPGLNSGVMIVQYVAASLVAENKVLCHPAAVDSIPTSENFEDHVSMGSLSAYHALQVAENVHRIIASELFAAFQAVSIRLRQLGYDEDDYSPLGQGSAAVMQCISEAGIKPYVGDEWFYEQLNVMSNLLKGEKLLQAVDEAVGPCKD

SEQ ID NO: 51 - DNA, 1641 bp, Unknown
  Obtained from environmental sample
atgatcaccatccggggagaaggactcaccatcgcccagatcgccgccgtcgcgcgcggggcgccggtgcggatgaccgatgacgaggccgtgctggcgcgcgtacgcgccagccgccagcggatcgtcgaggcgctcgagtcgggccagcagatctacggcgtgaccacgctctacggcggcatggccgacagggtcgtcccggcggaccggctcgaagcgctgcagcgggtgtcgctctggcatcacaaggtcggcgccggcccccgcctgccggtgccggacgtgcgcgcggcgatgctgctgcgtgccaactcgctgttgaagggggcctcgggcgtccgcgtggagctcgtcgagcgctacgtggcgttcctgaacgccggagcgacgccgcacgtctatcagcgcggctcgatcggggcgagcggcgacctctcgccgctggcctacatcggtgcggccgtgatcggcctcgaccgggcctggctcgtcgaccttggcgaagagaccctcgattgcctgacggtgctgcgccggctcggcctcgaaccgatgatcctgcagccgaaggagggcctggcgctctgcaacggcaccgccgcctcgaccggggtggcggccaactgcatcgagcgcgccttcgccctgaccgcgctcgcactcgggacgcatgcgctctacttccaggcgctcgacgccacgacccagtcgttcgagcccttcgtgcatgcgctcaagccccacccgggccaggtctggaccgcccgggagatggccgcgctgctcgacggctccggcctcgtgcgcagcgaggccgctggcgatcgtgcccaccgccggggcggactgatccaggaccgctactccctgcgctgcatgccccagttcgtcggtcccatcgtcgacggcctggccgaggctgcccgccagatcgagatcgaagccaattccgccaacgacaatccgctgatcgatccggagaccggcgaggtgttccacaccggcaacttcctggcggagtacaccgccgtggcgatggatcggctgcgctaccacctcggcatgctggccaagcacctggacacgcagatcgcgctgctggtggcgcccgagttcagccgcggcctgagcccgtcgctggcgggcaacctcgaaccggggctcaacgtcggcctgaagtcgctgcagatctcgtgcaacagcctgatgccgctgctgacgttctatggccagtcgatggccgaccgcttcccgacgcatgcggagcagttcaaccagaacatcaactcccaggcgatgaacggtgccaatctggcccgcgactcggtggaggtgctggcccacttcatggccaacgccctcgtcttcgccgtacaggccgtcgagctgcgagcctggctggtggctggcacctacgacgcatccgaggtgctctcgccggcgacccgcccgctgtatgcggccgcgcgcgccgccgccgccggtccgcccggaccgcaccgcccgctcgtctggaacgacaccgacggctttctggaggacaaggtccgcggcgtgatgtcgagcatcctggagggcggcgccgtgccggaggccgtcgcgccggtgcgcgagcgtctccgtgcgcatcgagggtag

SEQ ID NO: 52 - protein, 546 aa, Unknown
  Obtained from environmental sample
  DOMAIN (1)...(492): Phenylalanine and histidine ammonia-lyase
MITIRGEGLTIAQIAAVARGAPVRMTDDEAVLARVRASRQRIVEALESGQQIYGVTTLYGGMADRVVPADRLEALQRVSLWHHKVGAGPRLPVPDVRAAMLLRANSLLKGASGVRVELVERYVAFLNAGATPHVYQRGSIGASGDLSPLAYIGAAVIGLDRAWLVDLGEETLDCLTVLRRLGLEPMILQPKEGLALCNGTAASTGVAANCIERAFALTALALGTHALYFQALDATTQSFEPFVHALKPHPGQVWTAREMAALLDGSGLVRSEAAGDRAHRRGGLIQDRYSLRCMPQFVGPIVDGLAEAARQIEIEANSANDNPLIDPETGEVFHTGNFLAEYTAVAMDRLRYHLGMLAKHLDTQIALLVAPEFSRGLSPSLAGNLEPGLNVGLKSLQISCNSLMPLLTFYGQSMADRFPTHAEQFNQNINSQAMNGANLARDSVEVLAHFMANALVFAVQAVELRAWLVAGTYDASEVLSPATRPLYAAARAAAAGPPGPHRPLVWNDTDGFLEDKVRGVMSSILEGGAVPEAVAPVRERLRAHRG

SEQ ID NO: 53 - DNA, 1539 bp, Vibrio vulnificus ATCC 27562
atgcaagcagaaaataatattacctttggccaaggcagactgacgattgaggatgttgcggcgatcgctcaaggcgcaaaggccacgttaaataactcagttgaatttaccgccaaaatcgaccgcggtgtcgcctttctagaacgccttcttaaagaagaaggggtgatctatggcgtcaccacaggatacggcgactcttgtacagtcgcgataccgcctcaattggttgaagaactaccacttcacctcacgcgctttcacggctgtggcttaggcaaaattctcacccacgagcaagcgcgcgctgtacttgctacacgtctgtgttctttatcacaaggcgtttctggcgtaagtcatgacttactcaatcagatcgttactttgattaatcacgatatttcaccccgcattcctgaagaaggttcggtgggagccagtggtgatctcactcccctttcctaccttgctgcggcgctggttggtgagcgagaagtgatctaccaaggtgaagagcgtgcaaccgctgaagtctacgccgaacttggcatccaaccgattaaactgcgtcctaaagagggcttggcgctcatgaacggcacatccgtgatgaccgcgttagcttgccttgcctacaaacgcgcagagtatctagctcagctcagcaccaaaatcaccgcgatggtctctgtggccatgcacggtaatgacttccattttgatgaagcgctctttgcagtcaaacctcatccaggccaacaacagatcgccgcttggttgcgtgatgacctgaaagccgataagccgccacgcaacagtgaccgtctgcaagatcgttactcactgcgctgtgcgccgcacgtgattggtgttgtccaagattcactaccttggctgcgccaaatgatcgaaaacgagctcaacagtgccaatgacaacccaatcatcgatggtgataacgaacgtgttttacacggcggtcacttctatggtggtcacattgccatggcaatggacacactgaaaaccggtattgccaacctcgcggatctgctcgatcgtcaaatggcgcaattgatggattataagttcaacaatggcttaccatttaacttgagcggcgccgaaggggaacgcaagcccatcaaccatggttttaaagcggtgcaaattggcatttctgcttggaccgcagaagcgctcaagcacaccatgcctgccagcgtattctcgcgttcaaccgagtgtcacaaccaagataaagtgagcatggggactatcgctgcccgcgattgtttgcgagtattggaactgactgaacaggtggcggccgcgtctctacttgctgcaacacaagggatcgaaattcgccgccgtcgtggtgaactggacgaaaatcacatgagcgatcgtctgaaagccatctgcagctcggtactcaatgagtttgaatttgtcactgaagatcgcccattggaaaaagatctgcgccagttcatcactcacattcaacagcgtcattggtcactgtattaa

SEQ ID NO: 54 - protein, 512 aa, Vibrio vulnificus ATCC 27562
  DOMAIN (6)...(482): Phenylalanine and histidine ammonia-lyase
MQAENNITFGQGRLTIEDVAAIAQGAKATLNNSVEFTAKIDRGVAFLERLLKEEGVIYGVTTGYGDSCTVAIPPQLVEELPLHLTRFHGCGLGKILTHEQARAVLATRLCSLSQGVSGVSHDLLNQIVTLINHDISPRIPEEGSVGASGDLTPLSYLAAALVGEREVIYQGEERATAEVYAELGIQPIKLRPKEGLALMNGTSVMTALACLAYKRAEYLAQLSTKITAMVSVAMHGNDFHFDEALFAVKPHPGQQQIAAWLRDDLKADKPPRNSDRLQDRYSLRCAPHVIGVVQDSLPWLRQMIENELNSANDNPIIDGDNERVLHGGHFYGGHIAMAMDTLKTGIANLADLLDRQMAQLMDYKFNNGLPFNLSGAEGERKPINHGFKAVQIGISAWTAEALKHTMPASVFSRSTECHNQDKVSMGTIAARDCLRVLELTEQVAAASLLAATQGIEIRRRRGELDENHMSDRLKAICSSVLNEFEFVTEDRPLEKDLRQFITHIQQRHWSLY

SEQ ID NO: 55 - DNA, 1557 bp, Unknown
  Obtained from environmental sample
atggatcgcgttgataagaaaaagccgcttggcacggtgtgttttgccacggatcgcctgacgatcgaagatatcgtcggcatcgctcattgtgaagcgcgcgcctccctgtccgatgagccggcgtttcgcacttttatcagtcgtggcgcggcctttctagagcgctaccggtgcggcggcggttcggtctatggtgtaactaccggcttcggtgattcctgcaccgccaccgttgcgcccgagctggtggatgaattgccgcatcatctctaccgattccacggctgcggcttgggaaaacattttagtcctttggaaactcgcgcgattgtcgcggcgcgtctggcgtcgctgtgtaagggattctcgggggtcacgatagagctccttgagcaactcactcgactactgcgccaggacattctgccggtaattcccagtgaaggctccgtcggggccagcggcgatctcaccccgctttcatatcttgccgctgtagtttgtggcgaaggcgaggtgtggcgcggtgaagagattgttgccgcagcgccggctctggccggagccggcatcactccgctgcgattgcgtccaaaggaagcgctggcgatcatgaacggaaccgcagtcatgactgcattagcgtgtctggcctacatccgcgcagaatatcttgcccgacttacggctcgtattacagcgctggcctcgtttgctctggatgggaacgccgaacactttgatgctgcgctgtttgcactcaaaccccactctgggcagcaacgcgtcgccgcctggttgcgagcggacttggccagcggagtcggcatgttcgacggcaagcgattgcaggatcgctactcaatccggtgcgcgccccacgttatcggcgtgctggtagacgccttaccgtggctgcggcagttcatagagaacgaactcaacagtgtgaacgacaatccggtcgtggacggcgtcgacgaacgcgtgctgcacggcgggcacttctacggcggccacgtagcgtttgcgatggacagcatgaagaacgcggtggccaatctcgccgatctgctcgatcggcaaatggcactgctagtcgatgcccgttacagcaatggattaccggcgaatccctccggcgtcgaaggtcctcgtgccgcgatcaatcacggcctcaaggcgctgcaaatcagcacttcggcctggtgcgccgaagcgctcaagctgaccatgccggcttccgtattctcgcgctccaccgagtgtcacaaccaggataaggttagcatgggtacgatcgccgcgcgtgattgcctccgggtgttggaattgaccgagcaagtcgcggtgggattgttgatcacgacccgccaagccgtctggtggcgccgccgcttgagtccatcgcttactctcggcgtgtcgctgcaagaaatgctcgacgcgctcagtgccgatgtcgcgttgctcgaagaagaccgccggttggaaccagatctgcggcggcttttggaacgtttacgcggccgcgcctggaggctctatgactaa

SEQ ID NO: 56 - protein, 518 aa, Unknown
  Obtained from environmental sample
  DOMAIN (12)...(490): Phenylalanine and histidine ammonia-lyase
  SITE (152)...(168): Phenylalanine and histidine ammonia-lyases signature Prosite id=PS00488
  SITE (210)...(213): N-glycosylation site. Prosite id = PS00001
MDRVDKKKPLGTVCFATDRLTIEDIVGIAHCEARASLSDEPAFRTFISRGAAFLERYRCGGGSVYGVTTGFGDSCTATVAPELVDELPHHLYRFHGCGLGKHFSPLETRAIVAARLASLCKGFSGVTIELLEQLTRLLRQDILPVIPSEGSVGASGDLTPLSYLAAVVCGEGEVWRGEEIVAAAPALAGAGITPLRLRPKEALAIMNGTAVMTALACLAYIRAEYLARLTARITALASFALDGNAEHFDAALFALKPHSGQQRVAAWLRADLASGVGMFDGKRLQDRYSIRCAPHVIGVLVDALPWLRQFIENELNSVNDNPVVDGVDERVLHGGHFYGGHVAFAMDSMKNAVANLADLLDRQMALLVDARYSNGLPANPSGVEGPRAAINHGLKALQISTSAWCAEALKLTMPASVFSRSTECHNQDKVSMGTIAARDCLRVLELTEQVAVGLLITTRQAVWWRRRLSPSLTLGVSLQEMLDALSADVALLEEDRRLEPDLRRLLERLRGRAWRLYD

SEQ ID NO: 57 - DNA, 1557 bp, Unknown
  Obtained from environmental sample
atggagagcactgcgttcaagaacatgagccggacagtacgattcgatagggagtgggtgaagatccaagatatcgttgatattgccgacggagtagcctggcccgtactatctgagacgccacagttccgctccgcgattgcacaaggcgcggagtttgtcgaccgcctcctgcgtgaagacggcaggatctacggggtgacgacgggttttggcgattcgtgcatggtgacggttggaacggaactcgctgccgagttgccgcgccatctttatacgtatcacggttgtgggctcggggagtatctcacgccggcacagactcgggcagtcatcgcaacccgcttgacttctttatgcaaagggttctccggggtcagtgtcgatctgttggagcaaatggtgcgcttgctgcactgcggtgtgttaccgagaattccctgcgaaggctcggtgggcgccagcggtgatcttacgccgctctcttatctcgccgcggtgctctgcggcgagggcgaagtgtggcgcgacggcgccgcggcacccgcggcagtggctttggctcgtgcccgcatcgcgccattaagcctgcggcccaaggaagctctcgcgatcatgaatggctccgcagtcatgacggctttggcatgtctcgcttattcgcgcgccgagtatctaagccggctggtgactcgggtgacggcgctggcctcgtttgctttagacggcaatgcctatcacttcgacgagacgctactctcagtcaaacctcatccgggacagcagcgggtagctgcttggctgcgcgccgatttgctctgtgatcgaccgccgcgcaacgccacacgccttcaagaccgttattcgattcgctgcgcgcctcacgttatcggcgtgctcgccgatgccttaccatggctgtgccagtctatcgagaacgagctgaacagcgccaatgacaatccggttatcgatgcggccggtgaacgggttttatacggcggtcacttttatggcggccacatcgccttcgcgatggatagcatgaaaaacgccgtggctaatttggccgatcttctggaccggcaaatggcgctcctggtgggcagccgcttcaacaatggcttgccagccaatctgtccggcatcgagggcccgcggctggcgattaatcatgggctcaaagccctgcagatcagcgcttcggcatggacggcggaagcgctaaagctcaccatgccggcttcggtcttttcgcgttccactgaatgccacaatcaagacaaggtcagcatggggacaattgcagcgcgcgattgcctgcgcattttggaattgaccgagcaagttgtcgccgcgctgttgatcaccgtccggcaaggggtttggcttcgctgcagatcgaatggctctttgagattgcaagcggcgttacagacgatgatgcatcagttggagaacgatgtcgtcgcccttgaggaaggccgacggcttgaaccggacctgcgattacttctggaacgcatccgcagccgcgcgtggaaactctatgagtaa

SEQ ID NO: 58 - protein, 518 aa, Unknown
  Obtained from environmental sample
  DOMAIN (12)...(495): Phenylalanine and histidine ammonia-lyase
  SITE (8)...(11): N-glycosylation site. Prosite id = PS00001
  SITE (152)...(168): Phenylalanine and histidine ammonia-lyases signature. Prosite id = PS00488
  SITE (210)...(213): N-glycosylation site. Prosite id = PS00001
  SITE (284)...(287): N-glycosylation site. Prosite id = PS00001
  SITE (384)...(387): N-glycosylation site. Prosite id = PS00001
  SITE (476)...(479): N-glycosylation site. Prosite id = PS00001
MESTAFKNMSRTVRFDREWVKIQDIVDIADGVAWPVLSETPQFRSAIAQGAEFVDRLLREDGRIYGVTTGFGDSCMVTVGTELAAELPRHLYTYHGCGLGEYLTPAQTRAVIATRLTSLCKGFSGVSVDLLEQMVRLLHCGVLPRIPCEGSVGASGDLTPLSYLAAVLCGEGEVWRDGAAAPAAVALARARIAPLSLRPKEALAIMNGSAVMTALACLAYSRAEYLSRLVTRVTALASFALDGNAYHFDETLLSVKPHPGQQRVAAWLRADLLCDRPPRNATRLQDRYSIRCAPHVIGVLADALPWLCQSIENELNSANDNPVIDAAGERVLYGGHFYGGHIAFAMDSMKNAVANLADLLDRQMALLVGSRFNNGLPANLSGIEGPRLAINHGLKALQISASAWTAEALKLTMPASVFSRSTECHNQDKVSMGTIAARDCLRILELTEQVVAALLITVRQGVWLRCRSNGSLRLQAALQTMMHQLENDVVALEEGRRLEPDLRLLLERIRSRAWKLYE

SEQ ID NO: 59 - DNA, 1557 bp, Unknown
  Obtained from environmental sample
atggagagcatcggcgtcaagaaaacgacccgcactatccgattcaacatggattggatgaagatcgaagacatcgttgatgttgccgacagatcagcccggcccatattgtgccaagcgccggagttccgctcggctattgagcagggcgcggagtttgtcgaccggctcctacttgacgacggcaggatttacggcgtgacaacgggttttggcgattcatgcatggtgacggtcgggagtgaattagccgacgagttgccgcgccacctttatacttatcacggttgcggcctcggggagtatctcacacgggcccaaacccgcgcagtgattgcgacccgtctgacgtcgttatgtaaagggttttccggcgttggtgtcgaattgttggagcaaatggtgcgcttgctgcacgccgatctgttaccgagaattccatccgaagattcagtcggcgccagcggtgatctgacgccgctctcctatctggctgccgtactctgcggtgggggggaagtgtggcgcgaaggcactgcggcatccgcggccgtggctttggctgaggccggaatcgcgccgctaaggctgcggccgaaagaagctctcgcgatcatgaatggcaccgcggtgatgacggctttagcatgtctcgcttactcccgcgccgagtatctaagccggttggtgactcgggttaccgcgctggccttgtttgctctggacggcaatgcctatcattttgacgcaacactattctccgtcaaacctcatcgggggcagcagcgggtagccgtttggctgcgcgcggatctattatgcgacgaaccaccgcgcaacggcaggcgtcttcaggatcgctattcgattcgctgtgcaccccacgtcatcggcgtgctggccgatgccttaccctggctgcgcgagtctatcgagaacgaactgaacagcgccaatgacaatccgatcatagatgcggccggtgaacgggttttgtacggtggtcacttctatggcggtcacattgcgttcgcaatggacagcatgaaaaacgccgtggctaatttggccgatcttcttgaccggcaaatggcgctcctggtggacagtcgtttcaacaacggtttgcccgccaatctgtccggcatcgaggggccgcgtctagcgattaatcatggactcaaggcgttgcagatcagcgcttcggcatggacggcggaagcactaaagctgaccatgccggcttcggtcttttcgcgttccacagagtgccacaatcaagacaaggtcagcatggggacgatcgcagcgcgcgattgcctgcgcgtcttggaattgaccgagcaggttgtcgcggcgctgctgatcacagtccggcagggtgtctggcttcgccgcagattgaatccctctgcgaaactgcaaccggcgctacagagaatgctgcatgatctggagaacgacattagcgccatcgaggaagaccgacggctcgagccggacttgcgattccttttgcaacgcatccacagtcgagcatggaacctatatgaataa

SEQ ID NO: 60 - protein, 518 aa, Unknown
  Obtained from environmental sample
  DOMAIN (12)...(490): Phenylalanine and histidine ammonia-lyase
  SITE (210)...(213): N-glycosylation site. Prosite id = PS00001
  SITE (384)...(387): N-glycosylation site. Prosite id = PS00001
MESIGVKKTTRTIRFNMDWMKIEDIVDVADRSARPILCQAPEFRSAIEQGAEFVDRLLLDDGRIYGVTTGFGDSCMVTVGSELADELPRHLYTYHGCGLGEYLTRAQTRAVIATRLTSLCKGFSGVGVELLEQMVRLLHADLLPRIPSEDSVGASGDLTPLSYLAAVLCGGGEVWREGTAASAAVALAEAGIAPLRLRPKEALAIMNGTAVMTALACLAYSRAEYLSRLVTRVTALALFALDGNAYHFDATLFSVKPHRGQQRVAVWLRADLLCDEPPRNGRRLQDRYSIRCAPHVIGVLADALPWLRESIENELNSANDNPIIDAAGERVLYGGHFYGGHIAFAMDSMKNAVANLADLLDRQMALLVDSRFNNGLPANLSGIEGPRLAINHGLKALQISASAWTAEALKLTMPASVFSRSTECHNQDKVSMGTIAARDCLRVLELTEQVVAALLITVRQGVWLRRRLNPSAKLQPALQRMLHDLENDISAIEEDRRLEPDLRFLLQRIHSRAWNLYE

SEQ ID NO: 61 - DNA, 1557 bp, Unknown
  Obtained from environmental sample
atggagagcgccgagctaaagaaaacgacacggactatccgattcagtatggattggatgaagatcgaagacatcgttgatgttgccgacggtttagcctggcccatattgtctatagcgccggagttccgctcggctattgcggggggcgcggagtttgtcgaccgcctgctgcgcgaagacggcacgatctacggcgttacgacgggtttgggcgattcctgcatggtgacggtcgggagtgaattggcggccgagttgccgcggaacctttatacctatcacggttgcgggctgggcgagtacctcactccggcgcaaacccgcgccgtgattgcgacacgcctgacttctttatgcaaagggttttccggcattagtatcgaattgttggagcagatgatgcggttgctgcacgccgggctgttaccgagaattccatcggaaggttcggtcggcgccagcggtgatctaacgccgctttcttatctagccgccgtgctctgcggcgagggcgaagtgtggcgcgaaggctcggcggcgcctgcggcggcggttttggctgaagccggaatcgcccccttgagcctgcgaccaaaagaagctctcgcgatcatgaacggcaccgcggtcatgaccgctttggcatgtctcgcttactcacgcgccgaatacctaagccggttggtgactcgggttacggcgctggcctcggttgctttagacgggaatgcctaccattttgacgagacactattctcggtcaaacctcatcggggccagcagcggatagccgcttggctgcgggcggatctattatgtgacgaaccactgcgcaacgccaggcgtcttcaggaccgctactcgattcgctgcgcaccgcatgtgatcggcgtgctcgccgatgccttaccctggctgcgcgaatccattgagaacgagctgaacagcgccaatgataatccgatcatcgatgcagcaggtgaacgcgttttgtacggcggtcacttctatggcggccacattgcgttcgcaatggatagcatgaaaaacgccgtcgcgaatctagccgatctcctcgaccgacaaatggcgctcctggtagacagccgtttcaacaatggcttgccggctaatctgtccggcactgagggaccgcgtctagcgattaatcacggtctcaaagcgctgcagatcagcacttcggcatggacggcggaagcgctcaagctgaccatgccggcttctgtcttttcgcgttctactgagtgccataaccaagacaaggtcagcatggggacgattgcagcgcgggattgtctgcgcgttttggaattgaccgagcaagttgtcgcggccctgctgatcacggtgcggcagggggtctggcttcgccgcagattgaatccctctctggtattgcaaaggccgctgcagagaatgctacatcagttggagaacgatatcgccgcagttgacgaagaccggcgactcgagccggatttgcgattgcttttggagcgcatccatcatcgagcgtggaacttatatgaataa

SEQ ID NO: 62 - protein, 518 aa, Unknown
  Obtained from environmental sample
  DOMAIN (12)...(490): Phenylalanine and histidine ammonia-lyase
  SITE (152)...(168): Phenylalanine and histidine ammonia-lyases signature. Prosite id = PS00488
  SITE (210)...(213): N-glycosylation site. Prosite id = PS00001
  SITE (384)...(387): N-glycosylation site. Prosite id = PS00001
MESAELKKTTRTIRFSMDWMKIEDIVDVADGLAWPILSIAPEFRSAIAGGAEFVDRLLREDGTIYGVTTGLGDSCMVTVGSELAAELPRNLYTYHGCGLGEYLTPAQTRAVIATRLTSLCKGFSGISIELLEQMMRLLHAGLLPRIPSEGSVGASGDLTPLSYLAAVLCGEGEVWREGSAAPAAAVLAEAGIAPLSLRPKEALAIMNGTAVMTALACLAYSRAEYLSRLVTRVTALASVALDGNAYHFDETLFSVKPHRGQQRIAAWLRADLLCDEPLRNARRLQDRYSIRCAPHVIGVLADALPWLRESIENELNSANDNPIIDAAGERVLYGGHFYGGHIAFAMDSMKNAVANLADLLDRQMALLVDSRFNNGLPANLSGTEGPRLAINHGLKALQISTSAWTAEALKLTMPASVFSRSTECHNQDKVSMGTIAARDCLRVLELTEQVVAALLITVRQGVWLRRRLNPSLVLQRPLQRMLHQLENDIAAVDEDRRLEPDLRLLLERIHHRAWNLYE

SEQ ID NO: 63 - DNA, 1557 bp, Unknown
  Obtained from environmental sample
atggagagccctgcgttcaagaacatgagccggacagtacgattcgatagggagtgggtgaagatccaagatatcgttgatattgccgacggagtagcctggcccgtactatctgagacgccacagttccgctccgcgattgcacaaggcgcggagtttgtcgatcggctcctgcgtgaagacggcaggatctacggggtgacgacgggttttggcgattcgtgcatggtgacggttggaacggaactcgccgccgagttgccgcgccatctttatacgtatcacggttgtgggctcgggtcgtatctcacgccggcacagactcgggcggtcatcgcaacccgcttgacttctttatgcaaagggttctccggggtcagtgtcgaactgttggagcaaatggtgcgcttgctgcactgcggtgtgttaccgagaattccatccgaaggctcggtgggcgccagcggtgatcttacgccgctctcttatctcgccgcggtgctctgcggcgagggcgaagtgtggcgcgacggcgccgcggcacccgcggcagtggttttggctcgtgccggcatcgcgccattaagcctgcggccgaaggaagctctcgcgatcatgaatggtaccgcagtcatgacggctttggcatgtctcgcttactcgcgcgccgagtatctaagccggctggtgactcgggtgacggcgctggcctcgtttgctttagacggcaatgcctatcacttcgacgagacgctattctcagtcaaacctcacccggggcagcagcggatagctgcttggctgcgcgccgatttgctctgtgatcgaccgccgcgcaacgccacacgccttcaagaccgttattcgattcgctgcgcgcctcacgtcgtcggcgtgctcaccgatgccttaccgtggctgcgcgagtctattgagaacgagctgaacagcgccaatgacaatccggttatcgatgcggccggtgaacgggttttgtacggcggtcacttttatgggggtcacatcgccttcgcgatggatagcatgaaaaacgccgtggctaatttggccgatcttctggaccggcaaatggcgctcctggtagacagccgcttcaacaatggcttgccagccaatctgtccggcatcgagggcccgcggctggcgattaatcatgggctcaaagccctgcagatcagcgcttcggcatggacggcggaagcgctaaagctcaccatgccggcttcggtcttttcgcgttccactgaatgccacaaccaagacaaggtcagcatggggacaattgcagcgcgcgattgcctgcgcattttggaattaaccgagcaagttgtcgccgcgctgttgatcaccgtccggcaaggggtttggcttcgctgcagatcgaatggctctttgagactgcaagcggcgttacagacgatgatgcatcagttggagaacgatgtcgtcgcccttgaggaagaccgacggcttgaaccggacctgcgattacttctggaacgcatccgcagccgcgcgtggaaactctatgagtaa

SEQ ID NO: 64 - protein, 518 aa, Unknown
  Obtained from environmental sample
  DOMAIN (12)...(495): Phenylalanine and histidine ammonia-lyase
  SITE (8)...(11): N-glycosylation site. Prosite id = PS00001
  SITE (152)...(168): Phenylalanine and histidine ammonia-lyases signature. Prosite id = PS00488
  SITE (210)...(213): N-glycosylation site. Prosite id = PS00001
  SITE (284)...(287): N-glycosylation site. Prosite id = PS00001
  SITE (384)...(387): N-glycosylation site. Prosite id = PS00001
  SITE (476)...(479): N-glycosylation site. Prosite id = PS00001
MESPAFKNMSRTVRFDREWVKIQDIVDIADGVAWPVLSETPQFRSAIAQGAEFVDRLLREDGRIYGVTTGFGDSCMVTVGTELAAELPRHLYTYHGCGLGSYLTPAQTRAVIATRLTSLCKGFSGVSVELLEQMVRLLHCGVLPRIPSEGSVGASGDLTPLSYLAAVLCGEGEVWRDGAAAPAAVVLARAGIAPLSLRPKEALAIMNGTAVMTALACLAYSRAEYLSRLVTRVTALASFALDGNAYHFDETLFSVKPHPGQQRIAAWLRADLLCDRPPRNATRLQDRYSIRCAPHVVGVLTDALPWLRESIENELNSANDNPVIDAAGERVLYGGHFYGGHIAFAMDSMKNAVANLADLLDRQMALLVDSRFNNGLPANLSGIEGPRLAINHGLKALQISASAWTAEALKLTMPASVFSRSTECHNQDKVSMGTIAARDCLRILELTEQVVAALLITVRQGVWLRCRSNGSLRLQAALQTMMHQLENDVVALEEDRRLEPDLRLLLERIRSRAWKLYE

SEQ ID NO: 65 - DNA, 1551 bp, Unknown
  Obtained from environmental sample
atgcacattgacgcaacctcccactgcaagttcggccagaacgagttgaccatcgatgacgtggtcgacctggcccatcgccgccgacaggcggtactgtcgcaggaccctgcctttgccacgatgatccaggccggtgccgatttcctggatgacctgttgcgtcgcgagggagtgatctatggcgtgaccaccggttacggtgactcgtgcacggtcaacattccgccggctctgatcgctgacctgccgcatcacctgttcacttaccacggctgcggcttgggccgttacctggacccggtggagacccgcgcggtgctggccgcgcgcctggcctcgctggtgcgtggcatgtccggtgtcagcttgggcttgctgcaggggctgcaggccctgctggagcacgacatcctaccgttgattccggccgagggctcggtcggtgccagcggcgacctgaccccgctgtcctacgtggcagcggtgctgtgtggtgagcgcgaggtcttctatcagggccgcgtgcagccggccgccgaggccttggccagcgctgggctggccccgttgcggctgcggcccaaggaaggcctggcgatcatgaacggcaccgcggtgatgaccggcctggcttgcctggcttggcagcgtgccgattacctttcccgcctggccacgcgcctgaccgcgatcaacgtgctggccagcgatggcaatgcccaccatttcgacgccgtgctgttcggggccaagccgcacccgggccaggcccgcgtggcccagcgcctgcgcgatgacctggacagcgcacagccgccggtcaacctgaatcgcctgcaggaccgttattcgctgcgctgcgccccgcatgtcatcggtgtgctggaagacgcattgccgttcctgcgccagctgattcagactgaactcaacagtgccaacgacaacccgctggtggacgtggcggccgggcgtatcctgcatggaggtcatttctatggcggccacattgccctggccatggacacgctgaagaatgcggtggccaacttggccgatctgttggaccgccagatggcgctgctggtggacacccgctacaaccatggcctgccgtccaacctgtcggcctgccagggcgagcgcgcgccgataaaccacggcctgaaggccttgcagatcagcgtgtcggcatggaccgccgaggccctgaagcagaccatgccggcgtcggtgttctcgcgttcgaccgaatgtcacaaccaggacaaggtcagcatgggcacaatcgccgcgcgagactgcctgcgtgtgatcgagctgaccgagcaagtggtggcggccatgctgatcaccactcgccagggcttggccctgcgccagcgtgccggtctgcgggccacgctgcagccgcagctggagcagatgcaccaggacctgtgccggcgcattgcacttgtcgacgaggaccgcgccctggatggcgagctgcgtgcgctgctcgccgacatccgcaaccagcagtggtgcctgtatgagcagcactga

SEQ ID NO: 66 - protein, 516 aa, Unknown
  Obtained from environmental sample
  DOMAIN (8)...(490): Phenylalanine and histidine ammonia-lyase
  SITE (148)...(164): Phenylalanine and histidine ammonia-lyases signature. Prosite id = PS00488
  SITE (206)...(209): N-glycosylation site. Prosite id = PS00001
  SITE (380)...(383): N-glycosylation site. Prosite id = PS00001
MHIDATSHCKFGQNELTIDDVVDLAHRRRQAVLSQDPAFATMIQAGADFLDDLLRREGVIYGVTTGYGDSCTVNIPPALIADLPHHLFTYHGCGLGRYLDPVETRAVLAARLASLVRGMSGVSLGLLQGLQALLEHDILPLIPAEGSVGASGDLTPLSYVAAVLCGEREVFYQGRVQPAAEALASAGLAPLRLRPKEGLAIMNGTAVMTGLACLAWQRADYLSRLATRLTAINVLASDGNAHHFDAVLFGAKPHPGQARVAQRLRDDLDSAQPPVNLNRLQDRYSLRCAPHVIGVLEDALPFLRQLIQTELNSANDNPLVDVAAGRILHGGHFYGGHIALAMDTLKNAVANLADLLDRQMALLVDTRYNHGLPSNLSACQGERAPINHGLKALQISVSAWTAEALKQTMPASVFSRSTECHNQDKVSMGTIAARDCLRVIELTEQVVAAMLITTRQGLALRQRAGLRATLQPQLEQMHQDLCRRIALVDEDRALDGELRALLADIRNQQWCLYEQH

SEQ ID NO: 67 - DNA, 1524 bp, Unknown
  Obtained from environmental sample
gtgttaacgattggggaattcgctctcagcattgaagatattgtggctgttgcgcgtaaagaacatcaagtagcactgcctgcttcagatgagtggaatgcattgattcagcgcggcgcagattttctcgatcagttattgcaggatgaaggtgttatttatggcgtaaccacaggctatggcgattcttgccttgtggaaattccaccgcatcaagtgaatgaactgcctttgcatttgtctcgctttcatggatgcggcatgggccaaaatttggatttaatcacggcacgcgcagtggttgcagtccgtttatgctcgctggcacgcggctattcaggcgtatcgcatgccttgctgcagcgtctggcatggatgctgaatgaagatgtgattcccgtaattccatctgaaggttctgtcggcgctagcggtgatttaacgccattgtcttatattgcgggtgcgctggtaggcgagcgtgatgtgtattaccaaggcaagattgtccccattgcagaggtctatgccgaaaaaggcatgcagcctttggtgatgcgtcccaaagaaggtttagcgctaatgaatggtacggcagtgatgaccgccattgcttgcctgaactataaaaaagcagaacagattgctttggccagtaccatggtgacagcattgaatgtcttggcgctagaaggcaatcctagccattttgatgaagtactgtttgcgcaaaaaccgcatcctggtcagcagcagattgccactcaactgcgcgtatggctgaacagtcaagtgcagacagaacaccaaagttcacgcttgcaagaccgctactcattgcgctgtgcgccgcatattattggtgtgtttgaagactcaaaagtgtggctgcgccagtttattgaaaatgaattgaattctagcaacgataatccattgattgatccagtgaatttgcgtgtactgcatggcggacatttctatggtggtcatattgcacaggccatggatagtttgaaaatcatgattgccaatattgcagacttgatggaccgtcaactcgcgcaattggtcgattacaaaatgaataacggcctgccgcgtaacttgacgggttcaagcccagaacgcttaccgctgaatcatggttttaaagccgtgcagattggggtgtcggcatggacagcagaagcgctgaagcagactttgtcggcatccattttttctcgttcaaccgaatgtcataatcaggataaagtcagcatgggaaccattgcagcgcgtgatgcgagccgtgtgattacgctgactgaacaagtgatggcggcattgagctgcgcggcggtgcaggcggttaaattgaaaggtttagatacagaactcagtccagtattaacagcatttcaacagtgggtgcttcacagcttcaactatgtggaggaagatcgccctttacaaaacgagctgcaggcgctggtcaaccgttttgaagatttagaacttttgaacagcattgctgtataa

SEQ ID NO: 68 - protein, 507 aa, Unknown
  Obtained from environmental sample
  DOMAIN (1)...(477): Phenylalanine and histidine ammonia-lyase
  SITE (141)...(157): Phenylalanine and histidine ammonia-lyases signature. Prosite id = PS00488
  SITE (199)...(202): N-glycosylation site. Prosite id = PS00001
  SITE (310)...(313): N-glycosylation site. Prosite id = PS00001
  SITE (374)...(377): N-glycosylation site. Prosite id = PS00001
MLTIGEFALSIEDIVAVARKEHQVALPASDEWNALIQRGADFLDQLLQDEGVIYGVTTGYGDSCLVEIPPHQVNELPLHLSRFHGCGMGQNLDLITARAVVAVRLCSLARGYSGVSHALLQRLAWMLNEDVIPVIPSEGSVGASGDLTPLSYIAGALVGERDVYYQGKIVPIAEVYAEKGMQPLVMRPKEGLALMNGTAVMTAIACLNYKKAEQIALASTMVTALNVLALEGNPSHFDEVLFAQKPHPGQQQIATQLRVWLNSQVQTEHQSSRLQDRYSLRCAPHIIGVFEDSKVWLRQFIENELNSSNDNPLIDPVNLRVLHGGHFYGGHIAQAMDSLKIMIANIADLMDRQLAQLVDYKMNNGLPRNLTGSSPERLPLNHGFKAVQIGVSAWTAEALKQTLSASIFSRSTECHNQDKVSMGTIAARDASRVITLTEQVMAALSCAAVQAVKLKGLDTELSPVLTAFQQWVLHSFNYVEEDRPLQNELQALVNRFEDLELLNSIAV

SEQ ID NO: 69 - DNA, 1560 bp, Unknown
  Obtained from environmental sample
atgactggcatgacacagaacgcgaatccgacgctcatccttttcgatggcagtgcgctgaagatcgagcagatcgcggcgattgcccatcagcaagcgacggtgcagctctcgcccaatccggcttttcgcagtcgcattcagcggggtgcggattttctcgatcggctgctccgcgaagatggtgtcgtgtatggcgtgacgacgggctatggggattcctgcaccgtcgagattccgccggagctgatcccggtactgccgcatcatctctatgcctatcacggctgtggggccgggcgctttctcacggaagtggaaacgcgcgcggtgcttgcgtgccgcctggcatcgctgtgccagggcctgtcgggtgtgagttgggcgctgctcaagcaactggagcatttgctggcgcatgacatcctgccgcgcattccagcggaaggatcggtgggcgcgagcggcgatctcacgccgctgtcatatgtcgctgccgtgctgtgtggtgagcgcgatgtgatgtggaagggccaggtgctgcccgcggcccaagcgctcaaggaaaccggtgccgagccgctgcgcctgcggcccaaggaagggctcgcgctgatgaacggcacggccgtgatgacggcgctggcgtgcctggcgtggcagcgcgcagactacgtggcacgcctcgcatgccgcatcaccgctgcgaacgtggtgggcattgccggcaatgctcatcacttcgatgaaacgttgtttgcggccaaaccgcatgcaggccagcaacgcgcggcggcgcgcatccggggtgatttggtggcagaggcgccgctgcgcaactcgcatcgtctgcaggatcgttactcgctgcgctgcgcgccgcacgtgatcggagtgctggaggacgcgttgccgtttttgcgccagttgatcgaaggcgaactcaattccgccaacgacaacccgctgatcgaacccgatcaggaacgtgtgctgcatggcggtcacttctacggcgggcatattgcgctggcgatggatacactcaagaacaccgttgccaatgtggccgatctgttggatcgccagttggcgctgctcgtggacacccgctacagccagggcctgccgtcgaatttgtcggcggcacaaggggcacgccagcctatcaatcatggcctcaaggcgttgcagatcagtgcgtctgcgtggacggctgaagcgctcaagcagaccatgccggcgtcggtgttctcgcgttccacggaatgccacaaccaggacaaggtgagcatgggcacgattgccgcgcgcgatgcgttgcgcgtgttggagctcaccgaacaagtcattgccgccatgctgattgccgcgcgccaggccgtgccgctgcgtgagcgcattcagccaaatgtgccgattggcgaccacatgcgcgcctggatcgccgatctggcgggacgtgtggagctggtggaggaagaccgcgcattggaccgcgatttgcagaacctgttgatcgatatccgcgcatctgcctggagcctgtatgccgactga

SEQ ID NO: 70 - protein, 519 aa, Unknown
  Obtained from environmental sample
  DOMAIN (12)...(487): Phenylalanine and histidine ammonia-lyase
  SITE (152)...(168): Phenylalanine and histidine ammonia-lyases signature. Prosite id = PS00488
  SITE (210)...(213): N-glycosylation site. Prosite id = PS00001
  SITE (384)...(387): N-glycosylation site. Prosite id = PS00001
MTGMTQNANPTLILFDGSALKIEQIAAIAHQQATVQLSPNPAFRSRIQRGADFLDRLLREDGVVYGVTTGYGDSCTVEIPPELIPVLPHHLYAYHGCGAGRFLTEVETRAVLACRLASLCQGLSGVSWALLKQLEHLLAHDILPRIPAEGSVGASGDLTPLSYVAAVLCGERDVMWKGQVLPAAQALKETGAEPLRLRPKEGLALMNGTAVMTALACLAWQRADYVARLACRITAANVVGIAGNAHHFDETLFAAKPHAGQQRAAARIRGDLVAEAPLRNSHRLQDRYSLRCAPHVIGVLEDALPFLRQLIEGELNSANDNPLIEPDQERVLHGGHFYGGHIALAMDTLKNTVANVADLLDRQLALLVDTRYSQGLPSNLSAAQGARQPINHGLKALQISASAWTAEALKQTMPASVFSRSTECHNQDKVSMGTIAARDALRVLELTEQVIAAMLIAARQAVPLRERIQPNVPIGDHMRAWIADLAGRVELVEEDRALDRDLQNLLIDIRASAWSLYAD

SEQ ID NO: 71 - DNA, 1542 bp, Unknown
  Obtained from environmental sample
atgaacgcgacctcagggcctacaatcaggttcgacaatgggccggtgagaatcgaggacatcgtcggcatcgcggaggggtcggcccatgtcgtattgtccgattcccatgaattctgcggagccattaaccgcgggacggattttctcgatcgtttgctgcgtgaagagggtgcgatctatggcgtcaccaccggctacggcgattcgtgcaccgtggcggtccccgttgagttggtaggcgaactgccgcgtcatctctacacctatcacggctgcggactgggcgcgtatttgactcccgtacagacgcgggcggtgatggcgacccgcctcacttcgttatgcaaggggttctccggcgtcagcctggaattgttgcagcgaatcgtgaagttacttcagtgcgatatattgccgttgatcccatccgaaggctcagtgggtgccagcggtgatctgacgccgttatcgtattttgctgccgttttgtgcggcgagggtgacgtttggcacaacggcgtccgtctaagcgccgctcaggcgctgcctgaagcggggctgacgccacttcggttgaggccaaaagaaggtctggcgatcatgaacgggacggcgttaatgaccgctttggcttgcctggcgtttacacgcgccgagtatctcatgcggctggtcactcgcatcaccgccctggcgtcatttgcgcttgacggcaacgcgcaccattttgatgccaagttattctcggtgaagccgcatccaggcttgcagcgcgtggctggttggttgcgtcaagatttgccgtgcgatcagcggcaccgtaatggaaaacgtctccaggatcgctattcggtgcgttgtgcgccccatgtgatcggtgtgctagccgacgcgacgccatggttgcgcgctaccatcgaaaatgagctcaacagcgtcaacgacaatcccatcatcgatgccgaaggagaagctgtactgtatggaggccacttttacggtggacacatcgcgtttgcgatggacagcatgaaaaatgctgtcgcaaacctagcggatctacttgaccggcagatggcgctgctggtcgacagccgctacaacaatggcttgccggccaacttgtcgggagttcaagggccgcgtacagcgattaatcatgggctcaaagggttgcagatcagtgcttcggcatggactgcggaggcgctcaagttaacgatgccggcttcggtgttctcgcgttcgaccgagtgccacaaccaggacaaggttagcatgggaaccatcgcggcacgggattgtttgcgggtgctcgagctgaccgagcaagtcgctgcggcggtgctgataaccgtgcgccaaggcgtctggttgcgttgccgcctgaatcggtccaccacgccagacctgctgcgggacatgatggacgccttgagccgcgatatcccggtgatcgatgaagaccgcaaactggagccggatctgcgattaatgctggagcggattcgtggtcgggcctggaaactctatgaataa

SEQ ID NO: 72 - protein, 513 aa, Unknown
  Obtained from environmental sample
  DOMAIN (8)...(486): Phenylalanine and histidine ammonia-lyase
  SITE (2)...(5): N-glycosylation site. Prosite id = PS00001
  SITE (148)...(164): Phenylalanine and histidine ammonia-lyases signature. Prosite id = PS00488
  SITE (206)...(209): N-glycosylation site. Prosite id = PS00001
  SITE (380)...(383): N-glycosylation site. Prosite id = PS00001
  SITE (472)...(475): N-glycosylation site. Prosite id = PS00001
MNATSGPTIRFDNGPVRIEDIVGIAEGSAHVVLSDSHEFCGAINRGTDFLDRLLREEGAIYGVTTGYGDSCTVAVPVELVGELPRHLYTYHGCGLGAYLTPVQTRAVMATRLTSLCKGFSGVSLELLQRIVKLLQCDILPLIPSEGSVGASGDLTPLSYFAAVLCGEGDVWHNGVRLSAAQALPEAGLTPLRLRPKEGLAIMNGTALMTALACLAFTRAEYLMRLVTRITALASFALDGNAHHFDAKLFSVKPHPGLQRVAGWLRQDLPCDQRHRNGKRLQDRYSVRCAPHVIGVLADATPWLRATIENELNSVNDNPIIDAEGEAVLYGGHFYGGHIAFAMDSMKNAVANLADLLDRQMALLVDSRYNNGLPANLSGVQGPRTAINHGLKGLQISASAWTAEALKLTMPASVFSRSTECHNQDKVSMGTIAARDCLRVLELTEQVAAAVLITVRQGVWLRCRLNRSTTPDLLRDMMDALSRDIPVIDEDRKLEPDLRLMLERIRGRAWKLYE

SEQ ID NO: 73 - DNA, 1566 bp, Unknown
  Obtained from environmental sample
atgcatcccgttgacttgaagaagaactcaaactcagtccgtacgattcacttcgacgatggacggctgaaagtcgaggatattgtcgatatcgcggaagggtcggctagggtagcactgtccgatgcttctgaattccgctccgcgattgcgcgaggggcggactttctggaccgtttgctgcgcgaggagggcacgatttatggcgtcaccaccggctacggcgattcatgcaccgtgacagtcccgctggatttggtcgccgagttgccgcgccatctctacacttatcacggttgcgggctgggagagtatttaagtcccgtacagacgcgggccgtgatcgccacccgcctcacgtcgttgtgcaaaggattctctggcgtcagtctcgaactgctgcatcaacttgtgaggttgctgcagtgcgatttattgccattgattccatctgaaggttcggtgggcgccagcggcgatctcaccccactatcttatctcgctgccgtgttgtgcggcgagggcgaagtttggcgcgaaggcgtccatacgagcgccgtgcaggcactggctgaggccggtatcgcaccgctacggttgaggccaaaagaaggactggcgatcatgaatgggacgtcggtcatgaccgctttggcgtgccttgcttatgcgcgcgccgattacctcacccggctagtcactcgcatcaccgcattggcgtcgtttgcgctggacggcaatgcgcaccatttcgaggctacgttgttctcggtgaagccgcacccaggccagcagcgggtggccggttggttgcgtcaagacttggcgtgcgatcagctggaccccaacggaaagcgtctccaggatcgctactcgatccgttgtgcgccccacgtgatcggtgttctcgccgatgcgctgccatggttgcgcgagtccatcgaaaatgaactcaacagcgccaacgataatccgatcatcgacgcggagggcgaacgcgtgctctatggcggtcacttctacggggggcatattggatttgccatggacagcatgaaaaatgccgtcgcaaacctggcggatttgcttgaccggcagatggccctgctggtcgacagccggtacaataatgggttgccagccaatttgtctggggttcaagggccacgcgcagcgatcaatcatggcctcaaggggttgcagatcagtgtttcggcatggaccgcggaggcgcttaagttgaccatgccggcgtcggtgttctcgcgttcgaccgagtgccacaaccaggacaaagtcagcatgggtacgattgcggcacgcgattgtttgcgtgtgctcgaattgacggagcaagtcgccgcggcgttgctaatcaccgtgcgacagggggtttggctccgttgcaggctgaatcgatcagccgctcccgaggcgacgttgaagaaaatgatggacgccttgggcgctgatatcgccgaggttgaggaggaccgcaggttagagccggatttgcgattactactggagcgcatccgcgaccgtgtctgggaattgtatgaataa

SEQ ID NO: 74 - protein, 521 aa, Unknown
  Obtained from environmental sample
  DOMAIN (15)...(494): Phenylalanine and histidine ammonia-lyase
  SITE (155)...(171): Phenylalanine and histidine ammonia-lyases signature. Prosite id = PS00488
  SITE (213)...(216): N-glycosylation site. Prosite id = PS00001
  SITE (387)...(390): N-glycosylation site. Prosite id = PS00001
  SITE (479)...(482): N-glycosylation site. Prosite id = PS00001
MHPVDLKKNSNSVRTIHFDDGRLKVEDIVDIAEGSARVALSDASEFRSAIARGADFLDRLLREEGTIYGVTTGYGDSCTVTVPLDLVAELPRHLYTYHGCGLGEYLSPVQTRAVIATRLTSLCKGFSGVSLELLHQLVRLLQCDLLPLIPSEGSVGASGDLTPLSYLAAVLCGEGEVWREGVHTSAVQALAEAGIAPLRLRPKEGLAIMNGTSVMTALACLAYARADYLTRLVTRITALASFALDGNAHHFEATLFSVKPHPGQQRVAGWLRQDLACDQLDPNGKRLQDRYSIRCAPHVIGVLADALPWLRESIENELNSANDNPIIDAEGERVLYGGHFYGGHIGFAMDSMKNAVANLADLLDRQMALLVDSRYNNGLPANLSGVQGPRAAINHGLKGLQISVSAWTAEALKLTMPASVFSRSTECHNQDKVSMGTIAARDCLRVLELTEQVAAALLITVRQGVWLRCRLNRSAAPEATLKKMMDALGADIAEVEEDRRLEPDLRLLLERIRDRVWELYE

SEQ ID NO: 75 - DNA, 1563 bp, Unknown
  Obtained from environmental sample
atgcaccccgttaacctaaaaacctcaacctcagcccgtacgattatattcgacaatggaccgctgaaaattgaggacattgtggacatcgcggagggatcagctagcgtgacattgtccgatgcttctgaattccgctctgccatagcgcgaggggcggatttcctggatcggttgctgcgccaagaaggcatgatctatggcgtcaccacgggctacggcgattcgtgcaccgtgccggtcccgcttgagctggtcaccgagttgccgcgtcagctctacgtctatcacggttgtggactgggcgagtatttgagtccggtacagacgcgcgccgtaattgcaacccgcctcacgcccttgtctaaggggttctctggcgtcagtctggaactgctgcaacagatggtgacgttactgcagtgcgatatattgccgctgattccgtgtgaagggtcggcgggtgccagcggggatctcactccgctatcgtacctcgccgctgttttgtgtggcgagggtgaagtttggcacaacggcgtcaaggtaggcgctgcacaggcactgtctgacgctggtgtcacgccgctgcgactcagaccaaaagaaggactagccgtcatgaacgggacggcggtcatgaccgctttggcgtgccttgcttacgtgcgcgccgattatctcagtcggctagtcactcgcattaccgcgctagcgtcgtttgcgcttgacggcaatgcgcaccatttcgatgccacgttattctcagtgaagccacacccaggccagcagcgcgtggccagctggctgcgtcaagacttgctgtgcgatcagctgcactccaacggaaagcgtctgcaggatcgctattccatccgttgcgcgcctcacgtgatcggcgttctcgccgatgcgctaccatggttgcgcgagtcgatcgaaaatgaacttaacagcgccaatgataatcccatcgtcgatgcggaaggccaaaccgtactgcacggcggtcatttttacggcggccatatcgcgtttgccatggacagcatgaaaaatgccgtcgccaacctggcggatctgattgaccggcagatggcactcttggtggatagccgttacaacaatggtttgccggccaacttgtctggggtccaagggccacgtgcggcgatcaatcatgggctcgaggcgttgcagatcagcgcttcggcatggacagcggaagcgcttaagttgacgatgccggcgtcggtgttttcgcgttcgacggagtgccataaccaggacaaagtcagcatgggtaccattgcggcacgcgactgtttgcgggtgctcgaattggtggagcaagttgcagcggcggtgctgatcaccgtgcgacagggagtctggctccgttgcagactgaatcgatcggcggctccgggggcgtctctgaagaacatgatggacgccctgagcaccgatatcaacgtgatcgaggaagatcgtcgacttgagccggatttgcgactactgctagagcggatccgtgaccgcacctggaaactgtatgaataa

SEQ ID NO: 76 - protein, 520 aa, Unknown
  Obtained from environmental sample
  DOMAIN (14)...(492): Phenylalanine and histidine ammonia-lyase
  SITE (212)...(215): N-glycosylation site. Prosite id = PS00001
  SITE (386)...(389): N-glycosylation site. Prosite id = PS00001
  SITE (478)...(481): N-glycosylation site. Prosite id = PS00001
MHPVNLKTSTSARTIIFDNGPLKIEDIVDIAEGSASVTLSDASEFRSAIARGADFLDRLLRQEGMIYGVTTGYGDSCTVPVPLELVTELPRQLYVYHGCGLGEYLSPVQTRAVIATRLTPLSKGFSGVSLELLQQMVTLLQCDILPLIPCEGSAGASGDLTPLSYLAAVLCGEGEVWHNGVKVGAAQALSDAGVTPLRLRPKEGLAVMNGTAVMTALACLAYVRADYLSRLVTRITALASFALDGNAHHFDATLFSVKPHPGQQRVASWLRQDLLCDQLHSNGKRLQDRYSIRCAPHVIGVLADALPWLRESIENELNSANDNPIVDAEGQTVLHGGHFYGGHIAFAMDSMKNAVANLADLIDRQMALLVDSRYNNGLPANLSGVQGPRAAINHGLEALQISASAWTAEALKLTMPASVFSRSTECHNQDKVSMGTIAARDCLRVLELVEQVAAAVLITVRQGVWLRCRLNRSAAPGASLKNMMDALSTDINVIEEDRRLEPDLRLLLERIRDRTWKLYE

SEQ ID NO: 77 - DNA, 1569 bp, Unknown
  Obtained from environmental sample
atgatccacgccgagcaaactaacgccgtcgtcttcgacgatcacaggttatcgatcgaagacgtctgcgatctcgcctcgcggcgccgtgcagcgcgcctcagcgacgaaccaggcttcgtatccgccatcgagcgtggcgccgagctcgtcgatcgcttgctgcgcgaagacggcgtcgtttacggcgtcaccacgggatacggcgactcctgcaccgtcgcggtgccgggttccctggtcgaggagctgccccagaagctctacacctttcacggcttggggctcggcgcgccgctcgagccagagcaagcgcgcgcggtgctcgccgcgcgcctcacttcgctgtgcaagcgcatgtcgggagtgagctacggcttgctcaagcaaatcgagcggctcctcgtcaacgacctcttgcccgtgataccccaggaaggctcagtgggagcgagcggggacctgacgccgctctcgtacgttgccgcggtcgtgtgcggggagcgcgaggtgttcgacggcggcacgcgccggccgacttccgaggctctccgggcgcacggcatcgcaccgatccgccttcgccccaaggagggcctcgcggtgatgaacggcactgccgtcatgactgcgctcgcctgcctcgcgttccagcgcgccgcgcatctctcgcgcttggcaacgcgcgtaacggcgctctccgtcttagccgtcgcgggcaaccctcaccatttcgacgaaagcctgttccgagccaagccgcaccctggtcagcagcgcgtcgcagcgcgactccgcctcgacctcggcggacgagtcgccggccgcaacgagcaccgtctccaggatcggtacagcttacgctgtgccccgcacgtcattggcgtgctcgaggatgcgctgccgttcttccgaacggtgatcgagaacgagctcaacagcgcgaacgacaatccgctcgtggacgctaccgaggaacgcgtgctccacggcggtcatttctacggtggacacatcgccttcgcgatggatagtctgaaggcgctcgtcgcgagcgtcgcagatttactcgatcgacaagtcgcgctgctcttggacccgaaattcaatcacgggctcccggcgaacttgagcggagcaccgcagcagcgccggcccatcaaccacgggctcaaggcgctctccatcgccacgagcgcctgggcagcggaagcactgaagctcaccatgccggccgcctccttctcgcgctccacggagtgccacaaccaagacaaggtcagcatgggcacgatcgccgcgcgggattgcgtgcgcgtgctcgagctcagcgagcaagtcgcggtcgcgacgctgctcgcggcgacccaaggcctcgacctcaggctccaagagggctccctctctcgggagcagctctctccaggcatcactgagatgcaccgcgccgtgcgtgcgatcgtccccgagctcgtcgaagatcgcgcgctcgaaggggagctccgtgcgctcctcgagcacctgcgcaagcagcgcttcgagctcttctccacggggcccttgccatga

SEQ ID NO: 78 - protein, 522 aa, Unknown
  Obtained from environmental sample
  DOMAIN (9)...(490): Phenylalanine and histidine ammonia-lyase
  SITE (149)...(165): Phenylalanine and histidine ammonia-lyases signature. Prosite id = PS00488
  SITE (207)...(210): N-glycosylation site. Prosite id = PS00001
  SITE (381)...(384): N-glycosylation site. Prosite id = PS00001
MIHAEQTNAVVFDDHRLSIEDVCDLASRRRAARLSDEPGFVSAIERGAELVDRLLREDGVVYGVTTGYGDSCTVAVPGSLVEELPQKLYTFHGLGLGAPLEPEQARAVLAARLTSLCKRMSGVSYGLLKQIERLLVNDLLPVIPQEGSVGASGDLTPLSYVAAVVCGEREVFDGGTRRPTSEALRAHGIAPIRLRPKEGLAVMNGTAVMTALACLAFQRAAHLSRLATRVTALSVLAVAGNPHHFDESLFRAKPHPGQQRVAARLRLDLGGRVAGRNEHRLQDRYSLRCAPHVIGVLEDALPFFRTVIENELNSANDNPLVDATEERVLHGGHFYGGHIAFAMDSLKALVASVADLLDRQVALLLDPKFNHGLPANLSGAPQQRRPINHGLKALSIATSAWAAEALKLTMPAASFSRSTECHNQDKVSMGTIAARDCVRVLELSEQVAVATLLAATQGLDLRLQEGSLSREQLSPGITEMHRAVRAIVPELVEDRALEGELRALLEHLRKQRFELFSTGPLP

SEQ ID NO: 79 - DNA, 1551 bp, Unknown
  Obtained from environmental sample
atgttcccgagtgacggccaatcccaacgcacggtccgcttcggcacggagcggctgagcatcgaagatatcgtcgatattgcggcgggctcggcgcgcgcggctttgtccgatgcgccggaatttcgtgcagcgatcgcccgcggggcggattttttggatcgcctgctccgccgcgagggcgtgatttacggcgtcaccacgggagtcggcgattcctgcaccgtgacgatcgacctcgagctggtgggcgatctgccacgccatctttacacaatgcacggctgcgggctgggcgaatatctctccgcggcacagacgcgtgccgtcattgcaacccgactcgcgtcgttgtgcaaaggcttttcaggggtgagcttcgagctgcttgagcagatggtacgtctgctcgagcgcggcctgttgccgcttattccttcagagggttccgtcggcgccagcggcgatttgacgccgctctcgtatctcgccgcagcgctctgcggcgagggagaagtctgccgcgacggcaaaacggtttccgcagcggcggcgctcgccgaagccggcatcacgccgcttcgcctgcggccgaaagaagcactggcggtgatgaatggcacggcggtgatgaccgctttagcctgtctcgcctatgcgcgcgcggaatatttagcccgcctggcgacgcgcattaccgcgctttcgtcttttgctctggacggcaacgcgtatcatttcgatgcgatgctgttctcggtcaaaccgcacccgggccagcagcagatcgcggaatggctgcgccgagatttggcgtgcgcggcgccgacggacgagatccggcggctgcaggaccgctattcgattcgctgcgcgccccatgtgatcggcgtcctcgccgacgcgctgccgtggatgcgccagtcgattgaaaacgagctcaacagcgccaacgataatccgatcatcgacggtgccgccgaacggatcctacacggcggtcatttttacggcggccacatcgccttcgccatggacagcatgaaaaacgctgtagccaaccttgccgacctgctcgaccggcaaatggcgctgctggtcgacagccgctacaacaatggcctaccggccaatttgtccggcgcgcggagcgcgcgcacggcaatcaatcacggtctcaaagccttgcagatcggggtgtcagcatggaccgccgaggcgctcaagctgaccatgccggcgtcggtcttttcgcgctccaccgaatgccacaaccaggacaaagtaagcctgggcacgatcgccgcgcgcgattgcctgcgcgtactcgaattgaccgagcaggtcgctgccggtttactgatcgctggacgccagggcacctggctccggcgtcaaatcaactcagcggcgctatcggcgccggtcgaagccatgctggaattgctcgacgccgacactgcgccgattgaagaagaccgtcgcctcgaacctgagctgcgcattctcttggagcgcatccgcgcacgcgtctggaaactgtatgagtaa

SEQ ID NO: 80 - protein, 516 aa, Unknown
  Obtained from environmental sample
  DOMAIN (11)...(492): Phenylalanine and histidine ammonia-lyase
  SITE (151)...(167): Phenylalanine and histidine ammonia-lyases signature. Prosite id = PS00488
  SITE (209)...(212): N-glycosylation site. Prosite id = PS00001
  SITE (383)...(386): N-glycosylation site. Prosite id = PS00001
MFPSDGQSQRTVRFGTERLSIEDIVDIAAGSARAALSDAPEFRAAIARGADFLDRLLRREGVIYGVTTGVGDSCTVTIDLELVGDLPRHLYTMHGCGLGEYLSAAQTRAVIATRLASLCKGFSGVSFELLEQMVRLLERGLLPLIPSEGSVGASGDLTPLSYLAAALCGEGEVCRDGKTVSAAAALAEAGITPLRLRPKEALAVMNGTAVMTALACLAYARAEYLARLATRITALSSFALDGNAYHFDAMLFSVKPHPGQQQIAEWLRRDLACAAPTDEIRRLQDRYSIRCAPHVIGVLADALPWMRQSIENELNSANDNPIIDGAAERILHGGHFYGGHIAFAMDSMKNAVANLADLLDRQMALLVDSRYNNGLPANLSGARSARTAINHGLKALQIGVSAWTAEALKLTMPASVFSRSTECHNQDKVSLGTIAARDCLRVLELTEQVAAGLLIAGRQGTWLRRQINSAALSAPVEAMLELLDADTAPIEEDRRLEPELRILLERIRARVWKLYE

SEQ ID NO: 81 - DNA, 1563 bp, Unknown
  Obtained from environmental sample
atgcatcccgctaaccacataaacgtgacctcagggcgtacaattaggttcgacaatgggccggtgagaatcgaggacatcgtcggcatcgcggaggggtcggcccgtgtcgtattgtccgattcccatgaattctgcggggccattaaccgaggggcggattttctcgatcgtttgctgcgtgaagagggtgcgatctatggcgtcacgacaggctacggtgattcgtgcacggtggtggttcctgttgagcttgtgggcgaactgccgcgtcatctctacacctatcacggctgcgggctcggcgcgtatttgagtccggtacagacgcgggcggtgatggcgacccgcctcacttcgttatgcaaagggttctccggcgtcagtctggaattgctgcagcaaatcgtgaggttacttcagtgcgatatactgcccttgattccatccgaaggctcggtgggtgccagcggtgatctgacgccgttaccgtattttgctgccgttttgtgcggcgaaggtgaagtttggcacaacggcgtccgtctaagcgccgctcaggcgctgcctgaagccgggctaacgcccctccgattgaggcctaaagaaggcctggcgatcatgaatgggacggcggtaatgaccgctttggcttgcctggcgtttacacgcgccgagtatctcacgcggctggtcactcgcatcaccgccctggcgtcatttgcgcttgacgggaacgcgcaccattttgatgccaagttattctcggtgaagccgcatccgggcctggagcgcgtggctggttggttgcgtcaggacttgccgtgcgatcggcgggaccgcaatggaaagcgtctccaggatcgctattcggtgcgttgcgcgccacacgtgatcggtgtactagccgacgcgatgccatggttgcgcgctacaatcgaaaatgagctcaacagcgtcaacgacaatcccatcatcgataccgaaggcgaagccgtactgtatggcggccacttctacggtggacacatcgcgtttgcgatggacagcatgaaaaatgctgtcgcaaacctagcggatctccttgaccggcagatggcgctgctggtggacagccgctacaacaatggcttgccggccaacttgtctggagctcaagggccgcgtacagcgatcaatcatgggctcaaagggttgcagatcagtgcttcggcatggactgcggaggcgctcaagttaaccatgccggcctcggtgttctcgcgttccaccgagtgccacaaccaggacaaggtcagcatgggaaccatcgcggcacgggattgtttgcgggtgctcgagctgaccgagcaagtcgctgcggcgatgctaataaccgtgcgacaaggcgtctggttgcgttgccgcctgaatcggtccaccccgccagagatgatgctgcgggacatgatggacgcgctaagcaatgatatcccggtaatcgacgaggaccgcaaactggagccggatctgcgattaatgctggagcagattcgtggtcgtgcctggaagctctatgaataa

SEQ ID NO: 82 - protein, 520 aa, Unknown
  Obtained from environmental sample
  DOMAIN (14)...(493): Phenylalanine and histidine ammonia-lyase
  SITE (8)...(11): N-glycosylation site. Prosite id = PS00001
  SITE (212)...(215): N-glycosylation site. Prosite id = PS00001
  SITE (386)...(389): N-glycosylation site. Prosite id = PS00001
  SITE (478)...(481): N-glycosylation site. Prosite id = PS00001
MHPANHINVTSGRTIRFDNGPVRIEDIVGIAEGSARVVLSDSHEFCGAINRGADFLDRLLREEGAIYGVTTGYGDSCTVVVPVELVGELPRHLYTYHGCGLGAYLSPVQTRAVMATRLTSLCKGFSGVSLELLQQIVRLLQCDILPLIPSEGSVGASGDLTPLPYFAAVLCGEGEVWHNGVRLSAAQALPEAGLTPLRLRPKEGLAIMNGTAVMTALACLAFTRAEYLTRLVTRITALASFALDGNAHHFDAKLFSVKPHPGLERVAGWLRQDLPCDRRDRNGKRLQDRYSVRCAPHVIGVLADAMPWLRATIENELNSVNDNPIIDTEGEAVLYGGHFYGGHIAFAMDSMKNAVANLADLLDRQMALLVDSRYNNGLPANLSGAQGPRTAINHGLKGLQISASAWTAEALKLTMPASVFSRSTECHNQDKVSMGTIAARDCLRVLELTEQVAAAMLITVRQGVWLRCRLNRSTPPEMMLRDMMDALSNDIPVIDEDRKLEPDLRLMLEQIRGRAWKLYE

SEQ ID NO: 83 - DNA, 1566 bp, Unknown
  Obtained from environmental sample
atggatccaggtgacttggaaaagatctcgatctcgggtcctacgattcgattcgataacggaccgctgaagatcgaggacattgttgccattgcggaaggggcggctagcgtcgcattatccgaagctcctgaattccgctgcgccatttcgcgaggagcggactttctcgaccgcctgctacgcgaaaaggctacagtgtacggtgtaaccactggctacggcgattcatgcactgtacccgtaccggttgagttgatcgccgaattaccgcgccatttgtatatctatcacggttgcggattgggggagtatttgagtccggtacaaacgcgcgccgtgatcgcgacgcgcctcgcttcgctgtgcaaagggttttcgggcgtaagtctggagctgctccagcaactcgtgggtttaatacgatgcaacatactgccattggttccatctgagggctccgtcggcgccagtggcgatcttactccgctatcttacatcgctgccgttttgtgcggcgagggcgaagtttggcgcgacggcgtccatgtgcacgccgcacaggcgttggctgaggcgggcatgacgccattatggctgaggccaaaggaaggattggcggttatgaatggaacggcagtcatgactgctttggcctgccttgcttacgtgcgcgccgattatcttgctcgtctggtcactcgcatcaccgcattagcgtcgtttacgcttgacggcaatgcccagcactttgatgctacattgttttcggtgaagccgcatccagggcagcagcgagtggccgcttggctgcgtcaagacttgccgtgcgatccgcaggaccccatcggaaaacgtctccaggaccgctattcgatccgctgcgcaccgcacgtgattggtgttctcgccgacgcactgccatggctgcgcgagttcatcgaaaacgaactcaatagcgccaacgacaatcccattatcgacgccgagagggaagccgtgctgtacgggggtcacttctatggcggacatattgcgttcgcaatggacagcatgaaaaatgccgtcgcaaatctggcggatctgcttgaccgtcagatggcactgatagtcgacagccgttacaataatggtttgcctgacaatctatccggggttaaaggcccacgtgcggccatcaatcatggactgaaggcgttgcaaatcagtgcatcggcctggactggggaagccctcaagttgaccatgccggcatcggtgttctcgcgttcaaccgagtgtcacaaccaggacaaagtcagcatgggtaccatcgcggcccgcgactgtttgcgtgtgctcgaattgacggagcaagttgctgccgctctactgattaccgtgcgacagggggtgtggctccgttgcatggtgaatcgctccgtcgttccagaaacaaacttaaaaaggatgatggaggccgtaggcgctgacatccctgtgatcgaggaagaccgcaggttagagccggatttgcgcctactgttggaacgcattcgtggccgcgtttggaaactatatgaataa

SEQ ID NO: 84 - protein, 521 aa, Unknown
  Obtained from environmental sample
  DOMAIN (15)...(494): Phenylalanine and histidine ammonia-lyase
  SITE (155)...(171): Phenylalanine and histidine ammonia-lyases signature. Prosite id = PS00488
  SITE (213)...(216): N-glycosylation site. Prosite id = PS00001
  SITE (387)...(390): N-glycosylation site. Prosite id = PS00001
  SITE (479)...(482): N-glycosylation site. Prosite id = PS00001
MDPGDLEKISISGPTIRFDNGPLKIEDIVAIAEGAASVALSEAPEFRCAISRGADFLDRLLREKATVYGVTTGYGDSCTVPVPVELIAELPRHLYIYHGCGLGEYLSPVQTRAVIATRLASLCKGFSGVSLELLQQLVGLIRCNILPLVPSEGSVGASGDLTPLSYIAAVLCGEGEVWRDGVHVHAAQALAEAGMTPLWLRPKEGLAVMNGTAVMTALACLAYVRADYLARLVTRITALASFTLDGNAQHFDATLFSVKPHPGQQRVAAWLRQDLPCDPQDPIGKRLQDRYSIRCAPHVIGVLADALPWLREFIENELNSANDNPIIDAEREAVLYGGHFYGGHIAFAMDSMKNAVANLADLLDRQMALIVDSRYNNGLPDNLSGVKGPRAAINHGLKALQISASAWTGEALKLTMPASVFSRSTECHNQDKVSMGTIAARDCLRVLELTEQVAAALLITVRQGVWLRCMVNRSVVPETNLKRMMEAVGADIPVIEEDRRLEPDLRLLLERIRGRVWKLYE

SEQ ID NO: 85 - DNA, 1557 bp, Unknown
  Obtained from environmental sample
  misc_feature (1)...(1557): n is a, g, c or t
atgcatcccgctgacctaaaaacgacccgacgttccatacaattcgaccgtagccggttaagcatagaaaatgtggtcgatatcgcccatggccgtgccgccgccgaactgtcggcggacgcggatttccgcgcggcgatcgggcgcggcgccgattttctcgaccgcttgctgcgcgaagacggcactatctacggcgtcaccaccggctacggcgattcctgcacggtcggtattcctgccgagttggtggccgagttgccgcatcatttatacacctatcatggctgcggcctgggcgaatatctgactccggcacaaaccagagcagtgatggcgacccgtctggcatccctatccaaaggattttccggcgtcagcgtcgaactgctggagcagatacagcgcatgctggcggcggatttgctgcccttgatccccagtgaaggttcggtcggcgccagcggcgatttgacgcccttgtcctatctggccgcggcgctatgcggcgagcgcgaagtatggcgcaatggcgtgcacgtaccagccgcccaggcgctgagcgaggccggcatcaagccgctgcgcttgcgtcccaaagaaggcttggccatcatgaatggcacggcagtgatgacggcgcttgcctgcctggcattcgaccgggccgcctatctggttcgattgtgcacccgcatcaccgccatggcatcgtacgccctggatggcaatgcgcaccatttcgacgaaaccctgttctccgtcaaacctcatgccggcatgcaaggcgtcgccgcctggctgcgccaggatttggaaggcacccatggcgaacgcaacggcaagcgcctgcaagaccgctattcgatacgctgcgcgccacacgtgatcggcgtgctggccgatgccctgcctttcttcaggcagtcgatagaaaacgaattgaacagcgccaacgacaaccccatcatcgatgcggaaaacgagcgcgtgntgcatggcggccatttctacggcggccacatagcgttcgcgatggacggcatgaagaacgcggtggccaacctggcggacttgctggaccgccaaatggccttgctggtggacagccgctacaacaacggcttgccggccaacctgtcgggagcgcaaggagcgcgcgcacccgtcaaccacggcctgaaggcgctgcagatcagcgcatccgcctggaccgccgaagcgctcaaactgaccatgccggcatcggtattttcacgctccaccggatgccataaccaggacaaggtcagcatgggaacgatcgccgcgcgcgactgtttgcgcgtgctggaattgaccgagcaagtcgtggcggccatgctgatcaccgtacgccaaggcgtgtggctgcgctgccatgtcaaccccgcgcagatcctgacgcccgcgctggaacgcatggcggatatgctgggcaccgacattgctccggtcgaagaagaccgccgactggagccggagttgcgcgtattgctggagcgcgtacgtgcgcagacctgggatttatatgtctag

SEQ ID NO: 86 - protein, 518 aa, Unknown
  Obtained from environmental sample
  DOMAIN (12)...(491): Phenylalanine and histidine ammonia-lyase
  SITE (152)...(168): Phenylalanine and histidine ammonia-lyases signature. Prosite id = PS00488
  SITE (210)...(213): N-glycosylation site. Prosite id = PS00001
  SITE (384)...(387): N-glycosylation site. Prosite id = PS00001
  SITE (1)...(518): Xaa is any amino acid
MHPADLKTTRRSIQFDRSRLSIENVVDIAHGRAAAELSADADFRAAIGRGADFLDRLLREDGTIYGVTTGYGDSCTVGIPAELVAELPHHLYTYHGCGLGEYLTPAQTRAVMATRLASLSKGFSGVSVELLEQIQRMLAADLLPLIPSEGSVGASGDLTPLSYLAAALCGEREVWRNGVHVPAAQALSEAGIKPLRLRPKEGLAIMNGTAVMTALACLAFDRAAYLVRLCTRITAMASYALDGNAHHFDETLFSVKPHAGMQGVAAWLRQDLEGTHGERNGKRLQDRYSIRCAPHVIGVLADALPFFRQSIENELNSANDNPIIDAENERVXHGGHFYGGHIAFAMDGMKNAVANLADLLDRQMALLVDSRYNNGLPANLSGAQGARAPVNHGLKALQISASAWTAEALKLTMPASVFSRSTGCHNQDKVSMGTIAARDCLRVLELTEQVVAAMLITVRQGVWLRCHVNPAQILTPALERMADMLGTDIAPVEEDRRLEPELRVLLERVRAQTWDLYV

SEQ ID NO: 87 - DNA, 1563 bp, Unknown
  Obtained from environmental sample
atgcacctcgctgagctaaaaacctcaaccccggcccgtacgattgaattcgacaatggaccccggaaaatcgaggacattgtggacattgcagaaggatcggcaagcgtgacattgtctgatgcttccgaattccgctccgccatcacgcgcggggcggactttctggactgtctggtgcgcgaagagggcacaatctatggtgtcaccaccggctacggcgattcgtgcaccgtgccggtgccgcttgagctggtcgccgagttgccgcgccagctctatgtctatcacggttgcgggctgggcgagtatttgactccggtacagacgcgcgccgtaatagcaacgcgcctcacttcattgtccaagggattctctggcgtcagtcttgaattactccaacagatggtgaggttactgcagtgcgatttattgccgttgattccggctgaagggtcagtgggcgccagtggcgatctcactccgctatcgtacctcgccgcggtcttgtgtggcgagggtgaagtttggcgcaacggagtccaggtaagcgccgcgcaggcactgcccgaggctgggatcacaccgctacgactccggccaaaagaaggactggcgatcatgaatggcacagcggtcatgaccgctttggcgtgccttgcttacgtgcgcgccgattatcttacccggctagtgactcgcataaccgcactatcgtcatttgcgctcgacggcaatgcccaccatttcgatgctaaattgttctcgctgaagccgcatccaggccagcagcgcgtggccaattggctgcgtcaagatttgtccagcaatcagttggaccccaacggaaagcgtctgcaggatcgctattcgatccgctgcgcgcctcacgtgatcggtgttctcgccgatgcgctgccctggctgcgcgagtcgattgaaaatgaacttaatagcgccaacgataatcccatcgttgatgcagaagccagaaccgtattgtatgggggtcatttctacggagggcatatcgcgtttgccatggacagcatggaaaatgccgtagcaaatctggctgatctgattgaccgccaaatggcactcttggtggatagccgctacaacaatggtttgccggccaacttgtctggggttcaagggccacgtgccacgatcaatcatggactcaaggcgttgcagatcagtgcttcggcgtggacagcggaagcgcttaagttgacgatgccggcttcggtgttctcgcgctcgacggagtgtcacaaccaggacaaagtcagcatgggtacgattgcggcacgcgattgtttacgtgtgctcgaattggtggagcaagtcgccgcggcgcttctcatcgctgtgcgacagggagcctggcttcgttgtagactgaatcggtccgtgcttccgggagcaagcttaacgaatatgatggacgccctgagcactgatatcaacgtcatagaagaagatcgccgccttgagccggatttgcgactgctactagagcggatccgtggccgcgcctggaaactctatgaataa

SEQ ID NO: 88 - protein, 520 aa, Unknown
  Obtained from environmental sample
  DOMAIN (14)...(493): Phenylalanine and histidine ammonia-lyase
  SITE (154)...(170): Phenylalanine and histidine ammonia-lyases signature. Prosite id = PS00488
  SITE (212)...(215): N-glycosylation site. Prosite id = PS00001
  SITE (386)...(389): N-glycosylation site. Prosite id = PS00001
  SITE (478)...(481): N-glycosylation site. Prosite id = PS00001
MHLAELKTSTPARTIEFDNGPRKIEDIVDIAEGSASVTLSDASEFRSAITRGADFLDCLVREEGTIYGVTTGYGDSCTVPVPLELVAELPRQLYVYHGCGLGEYLTPVQTRAVIATRLTSLSKGFSGVSLELLQQMVRLLQCDLLPLIPAEGSVGASGDLTPLSYLAAVLCGEGEVWRNGVQVSAAQALPEAGITPLRLRPKEGLAIMNGTAVMTALACLAYVRADYLTRLVTRITALSSFALDGNAHHFDAKLFSLKPHPGQQRVANWLRQDLSSNQLDPNGKRLQDRYSIRCAPHVIGVLADALPWLRESIENELNSANDNPIVDAEARTVLYGGHFYGGHIAFAMDSMENAVANLADLIDRQMALLVDSRYNNGLPANLSGVQGPRATINHGLKALQISASAWTAEALKLTMPASVFSRSTECHNQDKVSMGTIAARDCLRVLELVEQVAAALLIAVRQGAWLRCRLNRSVLPGASLTNMMDALSTDINVIEEDRRLEPDLRLLLERIRGRAWKLYE

SEQ ID NO: 89 - DNA, 1563 bp, Unknown
  Obtained from environmental sample
atgcaccccgctgaccagaagaacgcaaccacagcccgtacaattaaactcgacaatggtcggctgagaatcgaggacattatggatatcgcggaggggtcggcccgtgtcgtattgtccgattcgcatgaattctgcgccgccattgaccgaggggcggattttctcgaccgtttgctgcgtgaagagggtacgatctatggtgtcaccaccggctacggcgattcgtgcaccgtgacggtcccggttgagctgatcggcgagctgccgcgccatctctacacctatcacggctgtgggctgggcgactatttgagtccggtacagacacgcgcagtgatggcgactcgcctcacatcgttgtgcaaagggttctccggcgtcagtctggaactgctgcggcaaatcgtaaagttactccagtgcgatctattaccattgattccatccgaaggctcagtgggtgccagcggtgatctcactccgttatcgtaccttgctgccgttttgtgcggcgagggtgaagtttggcgcaacggcgcccgtttaagcgccgctcaggcactgactgaggcagggatgacaccgctgcggttgaggccaaaagaaggactggcgatcatgaacgggacgtcggtaatgaccggtttggcttgccttgcgtatgcacgtgccgattatctcacccggctggtcactcgcatcaccgccctagcttcctttgcgcttgacggcaacgcgcagcattttgatcctaagttattctcggtgaagccgcatccaggcctgcagcgcgtggcgggctggttgcgtcaagacttgccgtgcgatcggcgtgaccgcgacggaaagcgtctacaggaccgttattcggtgcgttgcgcgccccacgtgatcggtgttctagcagacgccacgccgtggctgcgcgactccatcgaaaatgaactcaacagcgccaatgacaatcccatcattgatgcggaaggcgaaggcgtgctgtatggtggccacttttacggtgggcatatcgcgtttgccatggacagcatgaaaaatgccgtcgcaaacctggcggatctgcttgaccggcagatggccctgctggtcgacagccgctacaacaatggtttggcgcccaacttgtctggagctcatgggccacgtgcagcgatcaatcatgggctcaagggcctgcagattagtgcttcggcatgggcagcggaagcgctcaagttaacgatgccggcgtcggtgttctcgcgttcgacggagtgccacaatcaggataaagtcagcatgggcaccattgcggcacgggattctctgcgggtgctcgagctaaccgagcaggtcgctgccgcgatgctgatagccgtgcgacaaggtgtctggctgcgttgccggctgaaccgatccatggctccggaggcgacgctgcggaacatgatggacgcgctaggcgctgatatcccggtaatcgaggaggaccgcaagctagagccggatctcagactaatgctggagcgcattcgcggtcgggcctggaagctatatgaataa

SEQ ID NO: 90 - protein, 520 aa, Unknown
  Obtained from environmental sample
  DOMAIN (14)...(493): Phenylalanine and histidine ammonia-lyase
MHPADQKNATTARTIKLDNGRLRIEDIMDIAEGSARVVLSDSHEFCAAIDRGADFLDRLLREEGTIYGVTTGYGDSCTVTVPVELIGELPRHLYTYHGCGLGDYLSPVQTRAVMATRLTSLCKGFSGVSLELLRQIVKLLQCDLLPLIPSEGSVGASGDLTPLSYLAAVLCGEGEVWRNGARLSAAQALTEAGMTPLRLRPKEGLAIMNGTSVMTGLACLAYARADYLTRLVTRITALASFALDGNAQHFDPKLFSVKPHPGLQRVAGWLRQDLPCDRRDRDGKRLQDRYSVRCAPHVIGVLADATPWLRDSIENELNSANDNPIIDAEGEGVLYGGHFYGGHIAFAMDSMKNAVANLADLLDRQMALLVDSRYNNGLAPNLSGAHGPRAAINHGLKGLQISASAWAAEALKLTMPASVFSRSTECHNQDKVSMGTIAARDSLRVLELTEQVAAAMLIAVRQGVWLRCRLNRSMAPEATLRNMMDALGADIPVIEEDRKLEPDLRLMLERIRGRAWKLYE

SEQ ID NO: 91 - DNA, 1563 bp, Unknown
  Obtained from environmental sample
atgcatcccgctgacctgaagacctcaagcttacctcggacgattgaattcgaccatggatggctgaaaatcgaagacattgtcgatatcggcgaagggtcggctagggtggcgttgtccgatactgctgcatttcgctctggcattaagcgaggtgcggccttcctggaccgtctgctgcacgaagagggcacgatctatggcgttactaccggctacggcgattcgtgcacggtgacggtgccgcttgagctggtcgccgagttgccgcgccagctctatatctatcacggctgtgggttgggcgagtatctgagtccggtacagacgcgcgccgtgatggcgacccgcctcacatcgttgtgcaaagggttttctggcgtgagcttggaactcctgcaacaaatcgtgaggttactccagtgcgatttgttgccattgattccctcggaaggctcggtgggtgccagcggcgatctcactccgctatcgtatctcgctgcggttttgtgcggcgagggcgacgtttggcgtaacggcgtccatgtaagcgccgcgcaggcactggccgagggcggtatcacaccgctgcgtttgaggcccaaagaagggttggcgatcatgaatgggacggctgtcatgaccgctttggcctgccttgcttatgtgcgcgccgattatctcacccgactggttactcggaccaccgcactggcttcggttgcgcttgacggcaatgcgcaccatttcgatgccacgttgttcgcagtgaaaccgcatccgggcatgcagcgagtggcgggttggttgcgtcaagacttgccgtgcgatcagctggaccctaacagaaagcgtctgcaggatcgctattcgctccgctgcgcgccccacgtgatcggtgttctagccgacgcgctgccatggttgcgcgaatccatcgaaaatgaactcaacagcgccaacgacaatcccatcatcgatgcggaaggccaaggtgtcctgtctggcggtcacttttacggcgggcatatcgcatttgccatggacagcatgaaaaatgccgtcgctaacctggcggatctgctcgatcgacagatggcactgctggtcgatggccgctacaacaatgggctgccggccaacttatccggggctcaaggcccgcgcgccgcgatcaatcatgggctcaaggggttgcagatcagcgcttcggcatggactgcagaagcgctcaagttgaccatgccggcctcggtgttctcgcgctcgaccgagtgccataaccaggacaaagtcagtctgggtacgattgcagcacgcgattgtttgcgggtgctcgaattgacggagcaagtcgccgccgcgctgctcattaccgtacgacaaggagtctggctccgttgcaggctgaatcgatccgtcgctttgggagtggcgctaaggaacatgatggatgccctgagcaccgatatcaacgcgatagaggaagatcgtcgactggagccggatttgcgattactgctggagcgcatccatagccgtgtctggaagctgtatgaataa

SEQ ID NO: 92 - protein, 520 aa, Unknown
  Obtained from environmental sample
  DOMAIN (14)...(493): Phenylalanine and histidine ammonia-lyase
MHPADLKTSSLPRTIEFDHGWLKIEDIVDIGEGSARVALSDTAAFRSGIKRGAAFLDRLLHEEGTIYGVTTGYGDSCTVTVPLELVAELPRQLYIYHGCGLGEYLSPVQTRAVMATRLTSLCKGFSGVSLELLQQIVRLLQCDLLPLIPSEGSVGASGDLTPLSYLAAVLCGEGDVWRNGVHVSAAQALAEGGITPLRLRPKEGLAIMNGTAVMTALACLAYVRADYLTRLVTRTTALASVALDGNAHHFDATLFAVKPHPGMQRVAGWLRQDLPCDQLDPNRKRLQDRYSLRCAPHVIGVLADALPWLRESIENELNSANDNPIIDAEGQGVLSGGHFYGGHIAFAMDSMKNAVANLADLLDRQMALLVDGRYNNGLPANLSGAQGPRAAINHGLKGLQISASAWTAEALKLTMPASVFSRSTECHNQDKVSLGTIAARDCLRVLELTEQVAAALLITVRQGVWLRCRLNRSVALGVALRNMMDALSTDINAIEEDRRLEPDLRLLLERIHSRVWKLYE

SEQ ID NO: 93 - DNA, 1566 bp, Unknown
  Obtained from environmental sample
atgcatcccgttgacttgaagaagacctcaacctcagtccatacgattcaattcgacgatggacggctgaaaatcgaggacattgtcgatatcgcggaagggtcggctagtgtagcactatccgatgcttttgaattccgctccgccattgcgcgaggggcggactttctggaccgtctgctgcgcgaagagggcacgatttatggcgtcaccaccggctacggcgattcatgcaccgtgacggtcccgcttgagttggtcgccgagttgccgcgccatctctatgtctatcacggctgtgggctgggcgagtatttgagtccggtacagacgcgcgccgtgatcgccacccgcctcacgtcgttgtgcaaaggactctctggcgtcagtctggaactgctgcatcaactcgtgaggttactgcagtgcgatttattgccattgattccgtctgaaggttcggtgggcgccagcggcgatctcactccgctatcctatctcgccgccgtgttgtgcggcgagggtgaagttttgcgcaacggcgtccatgtaagcgccgcgcgcgcactggctgaggccggtatcgcaccgctgcggctgaggccaaaagaaggactggccatcatgaacgggacgtccgtcatgaccgctttggcgtgccttgcttatgcgcgcgccgattaccttatgcggctagtcactcgcatcaccgcattggcgtcgtttgcgcttgacggcaacgcgcaccatttcgatgctacgttgttctcagtgaagccgcatccaggccagcagcgggtggccggttggttgcgtcaagacttggcgtgcgatcagctggaccccaacggaaagcgcctccaggatcgctactcgatccgttgcgcgccccacgtgatcggtgttctcgccgatgcgctgccatggttgcgcgagtccatcgaaaatgaactcaacagtgccaacgacaatccgatcatcgacgcggagggcgaacgcgtgctctatggcggtcacttctatggggggcatattggatttgccatggacagcatgaaaaatgccgtcgcaaacctggcggatctgcttgaccggcagatggcgctgctggtcgacagccgctatagcaacggcttgccggccaatttgtctggggttcaagggccacgtgcagcgatcaatcatgggctcaaggggttgcagatcagtgtttcggcatggacggcagaagccctcaagttgaccatgccggcgtcggtgttctcgcgttcgaccgagtgccacaaccaggacaaagtcagcatgggtaccattgcggcacgcgattgtttgcgtgtgctcgaattgactgagcaagtcgccgcggcgctgctgatcaccgtgcgacagggagtctggctccgttgcaggctgaatcgatccgtcgctccggaggcgacgttgaagaacatgatggacgctttgggcgctgatatcgctgagattgaggaggaccgcaggctagagccggatttgcgattactgcttgagcggatccgcgaccgtgcctggaaattgtatgaataa

SEQ ID NO: 94 - protein, 521 aa, Unknown
  Obtained from environmental sample
  DOMAIN (15)...(494): Phenylalanine and histidine ammonia-lyase
MHPVDLKKTSTSVHTIQFDDGRLKIEDIVDIAEGSASVALSDAFEFRSAIARGADFLDRLLREEGTIYGVTTGYGDSCTVTVPLELVAELPRHLYVYHGCGLGEYLSPVQTRAVIATRLTSLCKGLSGVSLELLHQLVRLLQCDLLPLIPSEGSVGASGDLTPLSYLAAVLCGEGEVLRNGVHVSAARALAEAGIAPLRLRPKEGLAIMNGTSVMTALACLAYARADYLMRLVTRITALASFALDGNAHHFDATLFSVKPHPGQQRVAGWLRQDLACDQLDPNGKRLQDRYSIRCAPHVIGVLADALPWLRESIENELNSANDNPIIDAEGERVLYGGHFYGGHIGFAMDSMKNAVANLADLLDRQMALLVDSRYSNGLPANLSGVQGPRAAINHGLKGLQISVSAWTAEALKLTMPASVFSRSTECHNQDKVSMGTIAARDCLRVLELTEQVAAALLITVRQGVWLRCRLNRSVAPEATLKNMMDALGADIAEIEEDRRLEPDLRLLLERIRDRAWKLYE

SEQ ID NO: 95 - DNA, 1563 bp, Unknown
  Obtained from environmental sample
atgcagcccgctgagttgaagaccgcaagcttaccgcggacgatcacattcgaccacgggcggctaaaaatcgaagacattgtcgatatcgcggaagggtcagccagagttgcgttgtccaatgctgcggcatttcgctctagcattgagcgaggggcggacttcctgaaccgtctgttgcgcgaagagggcacgatttatggcgtgacgaccggctatggcgattcgtgcagcgtgaccgtgccgcccgatctgatcgccgacttgccgcgccaactctatatctatcacggctgcgggctgggcgagtatttgagcccggcacagacgcgcgccgtgatggcgacccgtctcgtatcgctgtgcaaaggtttttcgggcgtgagcctggaactgctacaacaaatcgtgagattactgcaatgcgatctattgccattgattccctcggaaggctcggtgggtgccagcggtgatctcaccccgctatcttacctcgcggcagttttgtgcggcgagggcgacgtttggcgcaacggcgtccatgtcagcgccgcccaggcgctcgccgagcaaggcattgcgccgctgcgtttgcgacccaaagagggactggcgatcatgaatgggacggccgtcatgaccgctttggcctgcctggcctacgtccgcgccgactatctcgcccggctggtgactcgcatcacggcgctggcgtcgtttgctcttgacggcaatgcgcaccatttcgatgccgcgttgttcgccgtgaaaccgcacccgggcatgcagcgagtggccggttggttgcgccaagacctgttctccgacccaccggaccccaaccgcaagcgtctacaagatcgctactcgatccgctgcgcgccccacgtaatcggcgttctggccgacgcgctgccatggttgcgcgactccatcgaaaatgaactcaacagcgccaacgacaatcccatcatcgatgcggcaagccaaggggtgttgtctggcggtcacttttacggcgggcatatcgccttcgccatggacagcatgaaaaatgccgtagccaacctggcggatctgctggaccgccagatggcactgctggtggaccgccgctacaacaatgggctgccggccaacctctctggggcccaagggcgacgcgccgcgatcaatcatgggctcaagggattgcagatcagcgcttcggcatggaccgctgaagcgctcaaattaaccatgccggcgtcggtcttctcgcgttcaaccgaatgtcataatcaggacaaagtcagtatgggtacgatcgccgcccgcgattgcttgcgggttctcgagttaacagagcaagtcgccgccgcgctgcttatcgccgtgcgacaaggcgtctggctccgttgcctaatcgatcggtccatcgcgccagggagcatgctgaaaagcatgatggacgcgttaggcgcggatatcggtgtgatcgaagaggaccgtaagctcgaaccggatttgcggttactgctggagcgcatccgtagccgcgtctgggagctgtatgaataa

SEQ ID NO: 96 - protein, 520 aa, Unknown
  Obtained from environmental sample
  DOMAIN (14)...(493): Phenylalanine and histidine ammonia-lyase
MQPAELKTASLPRTITFDHGRLKIEDIVDIAEGSARVALSNAAAFRSSIERGADFLNRLLREEGTIYGVTTGYGDSCSVTVPPDLIADLPRQLYIYHGCGLGEYLSPAQTRAVMATRLVSLCKGFSGVSLELLQQIVRLLQCDLLPLIPSEGSVGASGDLTPLSYLAAVLCGEGDVWRNGVHVSAAQALAEQGIAPLRLRPKEGLAIMNGTAVMTALACLAYVRADYLARLVTRITALASFALDGNAHHFDAALFAVKPHPGMQRVAGWLRQDLFSDPPDPNRKRLQDRYSIRCAPHVIGVLADALPWLRDSIENELNSANDNPIIDAASQGVLSGGHFYGGHIAFAMDSMKNAVANLADLLDRQMALLVDRRYNNGLPANLSGAQGRRAAINHGLKGLQISASAWTAEALKLTMPASVFSRSTECHNQDKVSMGTIAARDCLRVLELTEQVAAALLIAVRQGVWLRCLIDRSIAPGSMLKSMMDALGADIGVIEEDRKLEPDLRLLLERIRSRVWELYE

SEQ ID NO: 97 - DNA, 1563 bp, Unknown
  Obtained from environmental sample
atgcgaccaggtgacatgaaaacctcaacctcgacccgtacgattacgttcgacaacggaccggtgagaatcgaggacattgtggacatcgcggaagggtcggcaagcgcggtattgtccgctgcttccgaattccgcgctgcgatttcccgaggggcggactttctggactgtctggtgcgcgaagaaggcacgatctatggcgtcaccactggctacggggattcctgcaccgtgccggtcccgctcgaattggtcgccgagctgccacgccatctctacacttatcacggctgcgggctgggggagtatttaagtccggcccagacgcgggccgtgatcgcaacccgcctcacgtcgctgtccaaggggttctccggcgtcagtctggaactgctggaacagatggtgcggttactgcggtgcgatttattgccgttgattccgtgtgaaggctcggtgggtgccagcggcgatctaactccgctatcctacctcgccgctgttttgtgcggcgagggtgaagtttggcgcaacggcgtccaggtaggcgccgcgcaggcactgtctgaggccggcatcacgccgctgcgactccgacccaaagaaggactggccgtcatgaacgggacggccgtcatgacggctttggcgtgcctcgcttacgtgcgcgccgattatcttactcgcctagcaacgcgcattaccgcgctagcatcgtttgcgcttgacggcaatgcgcaccatttcgatgcgacgctgttctcagtgaagccgcatccaggccagcagcgcgtggccggttggctgcgcggagacctgccctgtgatcagctgagtcccaacgaaaagcgtctgcaggaccgctattcgatacgttgcgcgccgcacgtgattggtgttctcgccgacgcgctgccctggttgcgcgagtccatcgaaaatgaacttaatagcgccaacgataatcccatcgttgatgcggagagcaaaagcgtactgtacggcggtcatttttacggcgggcacatcgcgtttgccatggacagcatgaaaaatgccgtcgccaacctggcggatctgatggaccggcagatggcgctgctggtggatagccgctacaacaatggtttgccggcaaacttgtccggggttcaagggccgcgcgcagcgatcaatcatgggctcaaggcgttgcagatcagtacttcggcatggaccgcagaggcactaaagttgaccatgccagcgtcggtgttttcgcgctcgaccgagtgtcataaccaggacaaggtcagcatgggtacgattgcagcacgcgattgtttgcgtgtgctcgaattggtggagcaagtcgccgcggcgctgctcatcgctgtgcgacagggagtctggctccgttgcagattgaatcgatccctgcctccgggcgcaagcttaaagcacatgatggacgcgctcagcactgatatcaacatgatcgaggaagatcgtcgacttgagccagatttgcgactactgctggagcggatccgcagccgcgcctggaagctctatgaataa

SEQ ID NO: 98 - protein, 520 aa, Unknown
  Obtained from environmental sample
  DOMAIN (14)...(493): Phenylalanine and histidine ammonia-lyase
MRPGDMKTSTSTRTITFDNGPVRIEDIVDIAEGSASAVLSAASEFRAAISRGADFLDCLVREEGTIYGVTTGYGDSCTVPVPLELVAELPRHLYTYHGCGLGEYLSPAQTRAVIATRLTSLSKGFSGVSLELLEQMVRLLRCDLLPLIPCEGSVGASGDLTPLSYLAAVLCGEGEVWRNGVQVGAAQALSEAGITPLRLRPKEGLAVMNGTAVMTALACLAYVRADYLTRLATRITALASFALDGNAHHFDATLFSVKPHPGQQRVAGWLRGDLPCDQLSPNEKRLQDRYSIRCAPHVIGVLADALPWLRESIENELNSANDNPIVDAESKSVLYGGHFYGGHIAFAMDSMKNAVANLADLMDRQMALLVDSRYNNGLPANLSGVQGPRAAINHGLKALQISTSAWTAEALKLTMPASVFSRSTECHNQDKVSMGTIAARDCLRVLELVEQVAAALLIAVRQGVWLRCRLNRSLPPGASLKHMMDALSTDINMIEEDRRLEPDLRLLLERIRSRAWKLYE

SEQ ID NO: 99 - DNA, 1563 bp, Unknown
  Obtained from environmental sample
atgcatctcgctgagttgaaggccgcaagtttaccgcggacgattaaattcgaccagggtcggctgaaaatcgaagacattgtcgatatcgccgaaggatcggctaaggttgcgttgtccgatgctgcggcatttcgctctaacattgagcgaggggcggatttcctgaaccgtctcctgcgcgcagagggcacgatttatggcgttacgaccggctatggcgattcgtgcagcgtgaccgtgccgcctgatctggtcgccgagttgccgcgccaactctatatctatcacggctgtgggctgggcgagcatttgagcccggcacagacgcgggccgtgatagcgacccgcctcacgtcgctatgcaaagggttttctggcgtgagcctggaactgctgcaacaaatcgtaagattactgcagtgtgatctattgccattgatcccgtcggaaggctcggtgggtgccagcggcgatctcacgccgctatcttacctcgccgcggttttgtgcggcgagggcgacgtgtggcgcaacggcgtccatgtcagcgccgcccaggcgctcgccgagcaaggtattgcgcccctgcgtttgcgacccaaagagggtctggcgatcatgaatgggacggcagtcatgaccgctttggcctgccttgcctacgtgcgcgccgactatctcactcggctggtgactcggatcacggcgctggcgtcgtttgctcttgacggcaatgcgcatcatttcgatgccgcgttgttcgcggttaaaccgcaccccggcatgcagcgagtggccgcttggttgcgccaagacctgttgtccaacgcgccggatcccaacggcaagtgtctacaggatcgttactcgatccgttgcgcgccccacgtgatcggcgttctcgccgacgcgctgccgtggctacgcgactccatcgaaaatgaactcaacagcgccaacgacaatcccatcatcgatgcggcaagccagggggttttgtctggcggtcacttttacggcgggcatatcgccttcgccatggatagcatgaaaaacgccgtcgccaacctggcggatctgttggaccgccagatggcgttgctggtggatcgccgctacaacaatgggctgccggccaacttgtccggggctgaagggcgacgcgccgcgatcaaccatgggctcaaggggttgcagatcagcgcttcggcatggactgccgaagcgctcaaattaaccatgccggcgtcggtcttctcgcgctcaaccgagtgtcataaccaggacaaagtcagtatgggtacgatcgccgcccgcgattgcttgcgggttctcgagttgacggagcaagttgccgccgcgctgctcatcgccgtgcgacaaggcgtctggctccgttgccggctcgatcggtctatcgcgccagggagcatgctgaggagcatgatggacgcgttgggcacggacatccgtgtgatcgaagaggaccgtaagctcgaaccggatttgcggttactgctggagcgcatccgtagccgcgtctggaagctgtatgaataa

SEQ ID NO: 100 - protein, 520 aa, Unknown
  Obtained from environmental sample
  DOMAIN (14)...(493): Phenylalanine and histidine ammonia-lyase
MHLAELKAASLPRTIKFDQGRLKIEDIVDIAEGSAKVALSDAAAFRSNIERGADFLNRLLRAEGTIYGVTTGYGDSCSVTVPPDLVAELPRQLYIYHGCGLGEHLSPAQTRAVIATRLTSLCKGFSGVSLELLQQIVRLLQCDLLPLIPSEGSVGASGDLTPLSYLAAVLCGEGDVWRNGVHVSAAQALAEQGIAPLRLRPKEGLAIMNGTAVMTALACLAYVRADYLTRLVTRITALASFALDGNAHHFDAALFAVKPHPGMQRVAAWLRQDLLSNAPDPNGKCLQDRYSIRCAPHVIGVLADALPWLRDSIENELNSANDNPIIDAASQGVLSGGHFYGGHIAFAMDSMKNAVANLADLLDRQMALLVDRRYNNGLPANLSGAEGRRAAINHGLKGLQISASAWTAEALKLTMPASVFSRSTECHNQDKVSMGTIAARDCLRVLELTEQVAAALLIAVRQGVWLRCRLDRSIAPGSMLRSMMDALGTDIRVIEEDRKLEPDLRLLLERIRSRVWKLYE

SEQ ID NO: 101 - DNA, 1557 bp, Unknown
  Obtained from environmental sample
atgcatagccgtgacgttgtagccaacccccgccttgtccaattcgatcaagggtggctaaagcttgaggatatcgtggatcttgcgcacggatcggcgcatccggttttgtctgatgcccctcaattccgggatgcgattacgcgcggagccgattttctcgacggcttgctgcgccgggacggcatgatctacggcgttacgaccggctttggcgattcctgcacggtctcggttgagccggcactggtcgccgaattgccgcgccacctctatacctatcatggctgcggcttaggcgaatacttcacgccgacccaaacccgggcgatcatggcagtaaggctcgcgtcgttatgcaaaggcttttccggaatcagcatggatctcttggaccaaatcgcgaggctgctacaacggggtatcttgccgcgaattccgtcggaaggatcggtcggcgccagcggcgacttgacccctctgtcttatctcgcttcggtcctgtgcggcgaaggcgaagtctggggcgatggggcgattgtcaccgcagccgaagcgctggcgcgaaacggccttgcaccgctgcgcttgcgacccaaagaagccctggcggtgatgaacgggacggcggtaatgaccgccctggcctgcctagccttctcgcgtgcggagtatttaatgccgctggtgacgcgtattaccgcactggcctcgttcgccctcgacggcaatgcctaccatttcgacccgcgcctattcagcgtgaagcctcatcgcggcctgcaacgagtcgccgcttggttgcatcacgacctggccggcggcaacggcggcggtcatagtaggcgtcttcaggaccgctattcgattcgttgtgccccccacgtgatcggggtgcttgccgacgcattaccatggctgcgcgagtcgatcgaaaatgagctcaacagcgccaacgataatccgattatcgacccggtcggggagcgagtattgtacggcggccatttctacgggggccatatcgcatttgctatggattgcttgaagaacaccgtcgccaatctggccgatcttctcgaccgacagatggcgttattggtggacagccgctacagcaacggcttgccggcgaatctgtcgggtgtcgaaggtccgcgcgcggccatcaatcacggtttgaaggcgctgcagatcagcgcgacggcctggacggcggaagcactcaagctgaccacgcccgcatcggttttttctcgttccacggaatgccacaaccaggacaaagtcagtctgggtacccttgccgcccgggactgcttgcgggttgtggaactaaccgaacaggtagccgcggcactccttatcgcggtccggcagggcgtgtggctgcgctgccggaaaaattgttccggggctccgcaggcgccattgaaaagcatgttagaggcattgagcgtggatatccaagtcattgaagaggaccgcaggctagaaccggagttgcgccgtttgctggaacggatacggtgccgtgtttggaagctctatgactaa

SEQ ID NO: 102 - protein, 518 aa, Unknown
  Obtained from environmental sample
  DOMAIN (12)...(490): Phenylalanine and histidine ammonia-lyase
MHSRDVVANPRLVQFDQGWLKLEDIVDLAHGSAHPVLSDAPQFRDAITRGADFLDGLLRRDGMIYGVTTGFGDSCTVSVEPALVAELPRHLYTYHGCGLGEYFTPTQTRAIMAVRLASLCKGFSGISMDLLDQIARLLQRGILPRIPSEGSVGASGDLTPLSYLASVLCGEGEVWGDGAIVTAAEALARNGLAPLRLRPKEALAVMNGTAVMTALACLAFSRAEYLMPLVTRITALASFALDGNAYHFDPRLFSVKPHRGLQRVAAWLHHDLAGGNGGGHSRRLQDRYSIRCAPHVIGVLADALPWLRESIENELNSANDNPIIDPVGERVLYGGHFYGGHIAFAMDCLKNTVANLADLLDRQMALLVDSRYSNGLPANLSGVEGPRAAINHGLKALQISATAWTAEALKLTTPASVFSRSTECHNQDKVSLGTLAARDCLRVVELTEQVAAALLIAVRQGVWLRCRKNCSGAPQAPLKSMLEALSVDIQVIEEDRRLEPELRRLLERIRCRVWKLYD

SEQ ID NO: 103 - DNA, 1551 bp, Unknown
  Obtained from environmental sample
atgagcaaagcacaaatcaccttcaaccgcgctgccctgaaaattgaggacatcgtggccctagccgaagcccaagccgaagccagcctggatgccagcgcggacttcaaggcctacgtgaaccgcggcgccgagttcctggacaagctcctggaagaggacggtgtgatctacggcgtgaccacgggctatggcgattcagtcacggtggccgtgccagcctccctggtgcctgagctgccccagcacctcttcaccttccatggcgtgggcctgggagccatgctggatgcccaatccagccgtgccgtgctggccgtgcgcctagccacgctttgcaagggccgctcgggcgtgagctatgccctgctccagcaactggaggccctgctcaagaacgacatcctgcccgccattcctgaagaaggctcggtcggcgccagcggcgacctgacgcccctctcctacgtggccgctgtgctctgcggcgagcgcgaagtcctagccagcctggacggcctccagcttaagtccgcctccgaagccttgaaaaagcacggcctggccccccacaaactgcgccccaaggagggcctggccgtgatgaacggcactgcagtcatgacggccctggcctgcctagcctatcagcgcgccgactacctctcgcgcctgagcacgcgcatcagcgccatggcggttgaagccatggctggcaatccccaccatttcgacgaaaccctcttctcggtcaagccccatcccggtcagcagcgcatcgccgcccgcctccgcctggacttgggagacgcggtgacgacgaagcgtaacgagggcaggctccaggaccgctattccctgcgctgcagcccccaggtcatcggcgtgctggaagatgccctgcccttcctgcgcagcctcattgaaaacgaactcaatagcgccaatgacaaccccatcatcgacggtgaaggcggccacgtcctgcacggtggccatttctatggtggccatatcgcctttgccatggattccctcaaaaacgccgtcgccaatttggccgacctcatggaccgccaggtagcccagctcctggatcccaagttcaaccacggcctggcggccaacctttcaggctcacccctggcccgcgccagcatcaatcacggcctcaaggccctgggcattggcacttcggcctgggctgccgaggccctcaagctgaccatgccagcctcagtcttctcccgctccacggaaagccataaccaagacaaggtctccatgggcaccattgccgcccgcgactgcctgcgcgtgctagagctcaccgagcaagtggcggcaggagccctcttggccgtgagccagggcctggaactgcgcgaacgcaaggaaggcaaggcccccagcccggccctcaaggccatgcaaggcgagatccgcaaagacagcaagttcctggaagaagaccgccgcctggaccaggagctccgggtcctctgcggccgcattcgcaaccgtgcctggttgctctacgagggcaactga

SEQ ID NO: 104 - protein, 516 aa, Unknown
  Obtained from environmental sample
  DOMAIN (5)...(492): Phenylalanine and histidine ammonia-lyase
MSKAQITFNRAALKIEDIVALAEAQAEASLDASADFKAYVNRGAEFLDKLLEEDGVIYGVTTGYGDSVTVAVPASLVPELPQHLFTFHGVGLGAMLDAQSSRAVLAVRLATLCKGRSGVSYALLQQLEALLKNDILPAIPEEGSVGASGDLTPLSYVAAVLCGEREVLASLDGLQLKSASEALKKHGLAPHKLRPKEGLAVMNGTAVMTALACLAYQRADYLSRLSTRISAMAVEAMAGNPHHFDETLFSVKPHPGQQRIAARLRLDLGDAVTTKRNEGRLQDRYSLRCSPQVIGVLEDALPFLRSLIENELNSANDNPIIDGEGGHVLHGGHFYGGHIAFAMDSLKNAVANLADLMDRQVAQLLDPKFNHGLAANLSGSPLARASINHGLKALGIGTSAWAAEALKLTMPASVFSRSTESHNQDKVSMGTIAARDCLRVLELTEQVAAGALLAVSQGLELRERKEGKAPSPALKAMQGEIRKDSKFLEEDRRLDQELRVLCGRIRNRAWLLYEGN

SEQ ID NO: 105 - DNA, 1554 bp, Unknown
  Obtained from environmental sample
atgaaacatccactacgcactattcaattcgatcagaacaatcttagtatcgaagatatcgttgatatcgcgcaaggttccgtcaatgtcaaattatcggatgctgagcaatttcgggctgctattgctcatggagctgattttttagatcggttattacgtgaagatggaactgtgtatggagtaactaccggatttggtgattcctgcacggtagtagtaccgtcagagttggtagcagaattaccacaccgtctttatacttatcatggctgcggtttgggagaatattttaatcccgcacaaacccgtgccatcattgccacacgtttaacttctttatgcaaaggctattccggcgtcagcgtgaaattattggaacaaattactgcgttattacagcatgatttattgccgttaatgccgtgtgaaggttcagtgggcgccagtggcgatctgactcctttatcttatttagcagcagtattatgcggcgaacgtgaagtgtggtgcaataatgaacgtattcccgcagcgcaagcattaacaaatatcggtttacggccattaaaattacaacccaaagaggggcttgccattatgaacggcaccgccgtgatgactgcattagcttgcctggcttatgcgcgcgctgattacttatcccgcattgcaacgcgcatcactgccatggcaagtttcgctttagacggcaacgcgcatcattttgatgaaattttattttctgtaaaaccccatgcgggtcaacagcaagttgccgcttggttacggcaagatttattatgtgatgtaacgccgcgcaatgaaaaacgtttgcaggatcgttactccattcgctgtgcgccgcatgttataggtgtgctggtcgatgcattaccttggttacgtacatcgattgaaaacgaacttaacagtgctaacgataatccgatcatcgatgcagaaaatgaacgcgtgttacatggtggccatttttatggcggccatattgcatttgctatggatagtttaaaaaatctcgttgctaacattgctgatttgctcgatagacaaatggccttattagtagacaatcgttataaccatggtttgccagccaatttatcgggtgcaaaaggcgctcgtgctgccatcaatcatggtcttaaagctttgcaaattagtgtatcggcctggacagcagaggcattaaaattaactatgccggcatcggttttttcccgatcaacagaatgtcataatcaagataaagttagcatgggcactatcgctgcacgtgattgtttgcgcgttttagaattaaccgaacaagtagttgctgcactactcattaccgtgcgccaaggcgtgtggttacgttccgcattaaaaccggagcacgcattaattgatttacccgctaaacgcttggcgcagatgcaaacgtcattagcaaccgatattcctgtgattgaagaagatcgcatgttagaacctgaattacgattattattagatcgcattcgcgcgcgcgcctggaaattatatgaatag

SEQ ID NO: 106 - protein, 517 aa, Unknown
  Obtained from environmental sample
  DOMAIN (7)...(482): Phenylalanine and histidine ammonia-lyase
MKHPLRTIQFDQNNLSIEDIVDIAQGSVNVKLSDAEQFRAAIAHGADFLDRLLREDGTVYGVTTGFGDSCTVVVPSELVAELPHRLYTYHGCGLGEYFNPAQTRAIIATRLTSLCKGYSGVSVKLLEQITALLQHDLLPLMPCEGSVGASGDLTPLSYLAAVLCGEREVWCNNERIPAAQALTNIGLRPLKLQPKEGLAIMNGTAVMTALACLAYARADYLSRIATRITAMASFALDGNAHHFDEILFSVKPHAGQQQVAAWLRQDLLCDVTPRNEKRLQDRYSIRCAPHVIGVLVDALPWLRTSIENELNSANDNPIIDAENERVLHGGHFYGGHIAFAMDSLKNLVANIADLLDRQMALLVDNRYNHGLPANLSGAKGARAAINHGLKALQISVSAWTAEALKLTMPASVFSRSTECHNQDKVSMGTIAARDCLRVLELTEQVVAALLITVRQGVWLRSALKPEHALIDLPAKRLAQMQTSLATDIPVIEEDRMLEPELRLLLDRIRARAWKLYE

SEQ ID NO: 107 - DNA, 1545 bp, Unknown
  Obtained from environmental sample
gtgacgaagcgactggaattgggggccggcgatctgacgatcgccgacgtttggcgtattgctcaaggccctacggacatccgcattagcgatgcggcgatgacgcgtgtgcgccgttcggctgcgcacgtcgaaaacgcccttgcgcgcgacggcgtcatctatggcgtcaccaccggctacggcgacagcgtgaccaccgaggtgcccgcggcattggttgcggagctgccgctgcacctatcgcgctttcatggctgcggcatggggcgcgtgctcagcccacaagagacacgcgcggtgatggccgtgcgtctcgctgctttgttgcgcggctggtccggcgtttcagccgagctggtcacgctgctctgtgaaatgttgcgcgcggatattctgccgctcattccggccgaaggctcggttggcgcgagcggcgatctcacgccgctaagttacgttgttgctgcgctggtcggcgaacgcgatgtgctttttggtggcaagcggatggcggcttcggcggcgcttgccgaggctgggctaaagcccatcaagttgaaacccaaagaagcgctagcggtaatgaacggcaccgccgtgatgaccgggctcggcgtgctggcgtttgtgcgggcggagaatcttgcgcgcttgtcgtcgcggcttacggcgatggcttcgatcgcgctgttgggcaattcgcggcatttcgatccgcggctttcgctggccaaaccacatcctggccaggcgcgtgtcgcggcgcgcatcactgctgatcttgcgccatacgtgcgccttcatgccttctcgcgcttgcaagatcgttattcaattcgttgtgcgccccacgtcatcggcgttcttgaagatatgctcgcgccgttccgcgcgatgatcgaaactgaaatcaacagcgccaacgataacccgttgttcgatcccgagaccggagatgttctgcacggcgggcacttctacggtggccatatcgcctttgcgatggatagcctcaagaacctcgtcgccaatctcgctgatctgatggatcgtcagttcgcgcttctggtcgacaccaagttcagcaatgggctgcctgcaaatctttccggcgcgaccggtgcgcgcgccgccatcaaccacgggctaaaggccgtacaaatcgctgtgtctgcatggactgcggaagcgctgaaaaacacgatgccggcgagtgttttttcgcgttcgaccgaatgccacaatcaggacaaggtctcgatgggcaccattgccgcgcgcgacgcgatccgcgtgctggagctcaccgaacaggtcgccgcggcacacgttcttgcctgcggccaggctctgaagctgcggcttgcgtcgggcgaaattggcgcggctatgcttggcccgggcctgcaggcactggtcgatgcgacgccgctcattcaagaggacgagccgctcgataagcgcctgaccgatctgacgaacgccatcgcgcaagcacaatggaaattgtcgtggccgcatgacgcggagcaggcggaatga

SEQ ID NO: 108 - protein, 514 aa, Unknown
  Obtained from environmental sample
  DOMAIN (4)...(482): Phenylalanine and histidine ammonia-lyase
MTKRLELGAGDLTIADVWRIAQGPTDIRISDAAMTRVRRSAAHVENALARDGVIYGVTTGYGDSVTTEVPAALVAELPLHLSRFHGCGMGRVLSPQETRAVMAVRLAALLRGWSGVSAELVTLLCEMLRADILPLIPAEGSVGASGDLTPLSYVVAALVGERDVLFGGKRMAASAALAEAGLKPIKLKPKEALAVMNGTAVMTGLGVLAFVRAENLARLSSRLTAMASIALLGNSRHFDPRLSLAKPHPGQARVAARITADLAPYVRLHAFSRLQDRYSIRCAPHVIGVLEDMLAPFRAMIETEINSANDNPLFDPETGDVLHGGHFYGGHIAFAMDSLKNLVANLADLMDRQFALLVDTKFSNGLPANLSGATGARAAINHGLKAVQIAVSAWTAEALKNTMPASVFSRSTECHNQDKVSMGTIAARDAIRVLELTEQVAAAHVLACGQALKLRLASGEIGAAMLGPGLQALVDATPLIQEDEPLDKRLTDLTNAIAQAQWKLSWPHDAEQAE

SEQ ID NO: 109 - DNA, 1545 bp, Unknown
  Obtained from environmental sample
gtggcggaaatcattgaactgggcggacgcgatctgacgattggagacgtgtggcgcctcgctgccggcgaggccggcatgagcctaagcaaagatgccctggcgcgcgttaggcgctcctccgtccacgttgaaacggcgctggatcgcgacggcgaaatctacggcgtgaccactggctatggtgatagttgtaccacaagtgtgccgagcgagcttgtcgccgaactgccgctgcatctgacgcgattccatggctgcggcatgggtcgcacgctgacgcccgtggaaacgcgcgcggtgatggtggtccggctcacggctttgctacgcggttggtccggcgtgtccgtcgatttggtgacgttgctcgcggagatgctgcgccacgacattctgccgctcattcctgctgaaggatccgtgggcgccagcggagacttgacgccgctaagctacattgccggcgccctggccggggagcgcgacgtgctctatcgcggcaagcgcatgtcttcggccgcggcgttcgcggaagccggcttgaagcccatcacactgcggcccaaggaaggcctcgccgtgatgaatggcacagccgtgatgaccggcttggcggcgctggcttttgtgcgcgccgagggcttggcgcggctgacagcgcggctgacggccatggcggcaatcggattgcttggcaatccgaagcatttcgatccgcgtctgtcgcaggccaagccacatccagggcagggccgtgtggccgcgcgcatagccgcggatatggagctgtttgcgaaattgcacgcgccgacacggctgcaagatcgctactcgatccgttgcgcgccccacgtcatcggcgtgctcgaagacatgctgccgacgttgaggacactgattgaaacggagatcaacagcgccaatgacaatccgctgttcgatccagaaaccggcgacgtgttgcatggcggccatttttatggcggccacattgctttcgcgatggacagtctgaaaaatcttgtcgccaatctggccgacctgatggatcgtcagctcgcgttgctggccgacacgcgcttcaataatggtctgccgtccaacttgtctggcgccgttggcccgcgcgcggcaatcaatcacggtctcaaagcggtgcagatcgcggtctcggcttggaccgcagaggcgctgaaaaacactatgcccgcgagtgtgttctcgcgatcgaccgagtgtcataaccaggacaaggtttcgatgggcaccattgcggcgcgtgacgcgctgcgcgttctggagctgactgagcaggttgcggcggcgcatgtgctggcgtgcagccagtcgctgcgcctgcggcaaaggtctaacgaaatcagcccagccatgattggccccgccatgacggctttgatgcggaccgtgccactggtggaagaagacgcaccgctggacaagattttgggtgaagtgaccgccgccatcgcgcgtcgggattggagcattgattggcccggcgatgaggagcgggcggaatga

SEQ ID NO: 110 - protein, 514 aa, Unknown
  Obtained from environmental sample
  DOMAIN (4)...(484): Phenylalanine and histidine ammonia-lyase
MAEIIELGGRDLTIGDVWRLAAGEAGMSLSKDALARVRRSSVHVETALDRDGEIYGVTTGYGDSCTTSVPSELVAELPLHLTRFHGCGMGRTLTPVETRAVMVVRLTALLRGWSGVSVDLVTLLAEMLRHDILPLIPAEGSVGASGDLTPLSYIAGALAGERDVLYRGKRMSSAAAFAEAGLKPITLRPKEGLAVMNGTAVMTGLAALAFVRAEGLARLTARLTAMAAIGLLGNPKHFDPRLSQAKPHPGQGRVAARIAADMELFAKLHAPTRLQDRYSIRCAPHVIGVLEDMLPTLRTLIETEINSANDNPLFDPETGDVLHGGHFYGGHIAFAMDSLKNLVANLADLMDRQLALLADTRFNNGLPSNLSGAVGPRAAINHGLKAVQIAVSAWTAEALKNTMPASVFSRSTECHNQDKVSMGTIAARDALRVLELTEQVAAAHVLACSQSLRLRQRSNEISPAMIGPAMTALMRTVPLVEEDAPLDKILGEVTAAIARRDWSIDWPGDEERAE

SEQ ID NO: 111 - DNA, 1542 bp, Unknown
  Obtained from environmental sample
  misc_feature (1)...(1542): n is a, g, c or t
atgcaagccaacttccgcacagttcgattcgacgctggtcgaattgcgatcgaggacatcgtcgatatcggcgctggaaccgcgagggcagcattgtctaatgtaccagagtttctggctcagattactcgaggcgccgagttcctggaacgactcgtgaaggagaacgtcaccatttacggtgtcacgaccgggtacggcgattcctgcacggtcaagatcgctcctgacttgatcagcgagctgccgagtcatctctatacttatcatgcctgtggattgggtgaatgcttcagtccagagcagacccgcgcaataatagcgacccgtctcgcgtcattatgcaagggtttttccggtgttcgcctagagttgcttgaacagatggtaaggcttctggaatctaatgtactacccataattccatgcgaaggatctgtcggtgccagcggcgatcttaccccgttgtcctatctcgccgccgttctctgcggcgagggtgaagtctcttacaatggagtccgtatggaagctggactcgcgctcgcgaacataggccgtaagcctctacagctccggccgaaagaaggtctggccattatgaatggcacggcggtaatgacagcgttggcttgccttgcctatgcgcgggctgaatatttgcttcgactagccacccgtgttaccgccttggcggtctttgcgctggacggcaacgcctatcactacgacgccacacttttttctgtgaagccgcatgcgggccagcaacaaatcgcagcttgnctgcgtcatgatttgggatgcgaccagcaatcaattaacgatatccgcttacaggaccgctattcgcttcgctgcgcgccgcatgtgatcggtgttctagcggatgcgctaccctggctacgcgattcgatcgaaaacgagctcaacagcgccaacgacaatccgagcgtcgatccggagactgaacgggtactctacggcggtcatttttatggcggccatatcgcgtttgcgatggacagcatgaaaaacacagtcgccaatttggccgatctcctcgaccgccagatggcattgttagttgacagccgctacaacaatggtctgccgccgaatttatccggagccgagggcccgcgcctcgccatcaatcatggccttaaggccctccagatcagcgtcacggcgtggacaacagaggcgctcaagatgaccatgcccgcgtcggtattctcgcgctcaacggagtgtcacaaccaggacaaggtcagtctcggaactcttgctgcgcgcgattgcttgcgtgttctggaattgaccgagcaagtggtcgccgcgctgctgataactgtcaggcagggagtctggttgcgctgtagaataaactcttccgccgccttacaggaaccgttaaaaagtatgctcgcgctattggctgccgacgttaaagtcattgaagaggatcgaaagttagaaccggatttgcggttgctgctcgaacgcattcgtagccgcgcttggaagctgtatgactaa

SEQ ID NO: 112 - protein, 513 aa, Unknown
  Obtained from environmental sample
  DOMAIN (7)...(485): Phenylalanine and histidine ammonia-lyase
  SITE (1)...(513): Xaa is any amino acid
MQANFRTVRFDAGRIAIEDIVDIGAGTARAALSNVPEFLAQITRGAEFLERLVKENVTIYGVTTGYGDSCTVKIAPDLISELPSHLYTYHACGLGECFSPEQTRAIIATRLASLCKGFSGVRLELLEQMVRLLESNVLPIIPCEGSVGASGDLTPLSYLAAVLCGEGEVSYNGVRMEAGLALANIGRKPLQLRPKEGLAIMNGTAVMTALACLAYARAEYLLRLATRVTALAVFALDGNAYHYDATLFSVKPHAGQQQIAAXLRHDLGCDQQSINDIRLQDRYSLRCAPHVIGVLADALPWLRDSIENELNSANDNPSVDPETERVLYGGHFYGGHIAFAMDSMKNTVANLADLLDRQMALLVDSRYNNGLPPNLSGAEGPRLAINHGLKALQISVTAWTTEALKMTMPASVFSRSTECHNQDKVSLGTLAARDCLRVLELTEQVVAALLITVRQGVWLRCRINSSAALQEPLKSMLALLAADVKVIEEDRKLEPDLRLLLERIRSRAWKLYD

SEQ ID NO: 113 - DNA, 1545 bp, Unknown
  Obtained from environmental sample
atgacgacgccaacccatgagccggtaaccttcggcgaacgccctttgcgcatcgaagacgtgctggccctggccaaccgtcaggcgcccgtgcagttgcagagcgacgccgactaccgtgaacgcatcgccaagggcgcgcggttcctcgattcgctgctggacaaggaaggcgtgatctacggcgtgaccaccggttacggcgactcctgcgtggtggcggtgccgctgcatcacgtcgaagcgctgccgcagcatctctacaccttccacggttgtggactgggcaaactgctcgacgcccaggccacccgcgcagtgctggcggcgcgtctgcagtcgctgtgccacggcgtgtccggggtgcgcatcgagctgctggaacgcctgcatgccttcctcgaacacgacatcctgccgctgatccccgaagagggttcggtaggcgccagcggcgatctgacgccgctgtcctacgtcgccgcgaccctctccggcgagcgtgaagtgatgttccgtggcgagcgccgccaggctgccgatgtgcatcgtgaactgggctggaccccgctggtgctgcgcccgaaagaagcgctggcactgatgaacggcaccgccgtgatgaccggcctcgcctgcctggcctacgcccgcgccgattacctgctgcaactggccacccgcatcaccgcgctgaacgtggtggcgctgcaaggcaatccggagcacttcgacgagcgcctgttcgccgccaagccgcatccggggcagatgcaggtcgccgcgtggctgcgcaaggatctggcgatcgacgcgccgaccgcgccgctgcatcgtctgcaggatcgctattcgctgcgttgcgcaccgcacgtgctcggcgtattggccgacagcctgaactggctgcgttcgttcatcgagaccgaactcaacagcgccaacgacaacccgatcatcgacgccgaagccgagcgcgtgctgcacggcgggcacttctacggcggacacatcgcgttcgccatggacagcctgaaaaaccttgtggccaacgtcaccgacctgcttgaccgccaactcgcgctgctggtggacgagcgttacaaccacggtttgccgagcaacctgtccggcgccagcgcggatcgggcgatgctcaaccacggcttcaaggccgtgcagatcggcgccagcgcctggaccgccgaagcgttgaaaaacaccatgccggccagcgtcttctcgcgctccaccgagtgccacaaccaggacaaggtgagcatgggcaccatcgccgcccgcgacgccattcgcgtgctggagctgaccgaacaggtggccgccgccacgctgctcgcggccaatcagggtgtgtggctgcgtggccgtgatgaagacgcacgaccactgcctccgtcgctggccgcgatgcacgaagcgctggccaaagacttcccgccggtgatcgaagaccgcgccctggaaggcgaactgcgcctgtgcctgcaacgtatcgccgaacaacactggaggctgcatgcgtag

SEQ ID NO: 114 - protein, 514 aa, Unknown
  Obtained from environmental sample
  DOMAIN (8)...(486): Phenylalanine and histidine ammonia-lyase
MTTPTHEPVTFGERPLRIEDVLALANRQAPVQLQSDADYRERIAKGARFLDSLLDKEGVIYGVTTGYGDSCVVAVPLHHVEALPQHLYTFHGCGLGKLLDAQATRAVLAARLQSLCHGVSGVRIELLERLHAFLEHDILPLIPEEGSVGASGDLTPLSYVAATLSGEREVMFRGERRQAADVHRELGWTPLVLRPKEALALMNGTAVMTGLACLAYARADYLLQLATRITALNVVALQGNPEHFDERLFAAKPHPGQMQVAAWLRKDLAIDAPTAPLHRLQDRYSLRCAPHVLGVLADSLNWLRSFIETELNSANDNPIIDAEAERVLHGGHFYGGHIAFAMDSLKNLVANVTDLLDRQLALLVDERYNHGLPSNLSGASADRAMLNHGFKAVQIGASAWTAEALKNTMPASVFSRSTECHNQDKVSMGTIAARDAIRVLELTEQVAAATLLAANQGVWLRGRDEDARPLPPSLAAMHEALAKDFPPVIEDRALEGELRLCLQRIAEQHWRLHA

SEQ ID NO: 115 - DNA, 1551 bp, Unknown
  Obtained from environmental sample
atgagcaaacctaaaatcacgtttagcagaaatgctttaagcatcgaagatgtcgttgcgttggcagaagccaaggctgaagccagcctggaaacccaggccgatttcaaagcctatgtcagccgcggtgcagacttcttggataaacttttggaagaagacggcgtgatctacggcgtcaccactggctacggggactcggtcaccgtggctgtcccggcttcgctcgtggccgagcttccccagcacctctacaccttccacggcgtgggcctgggtgccatgctaggggcccaagaaagcagggccgtcttggccgtgcgcctggccacgctctgcaagggccgctctggggtcagctatgccctgctccagcaattggaatccctactcaagaacgatatcctgcctgccatccctgaagaaggctcggtcggcgccagcggcgatttaacacccctgtcttatgtggctgctgtgctttgcggagaccgtgaagtcctggcaagcccggatggcttgaagctcagccctgcatccgaagcccttaaaaaacacggactccagccccacaaactcaggcccaaggaaggcctagccgtgatgaatggcacggccgtgatgacggccctggcctgcctggctttcaagcgcgccgactacctcagccgtctgagcacccgcatcagcgccatggccgtggaggccatggccggcaatccccagcactttgacgagacgctcttttcagtcaagccccatcctggccagcagcgcatcgccagccgcctgcgctcggacctaggggatgccgtcacggtcaagcgcaacgaagggcgcctgcaggaccgctattccctgcgctgcagcccccaggtgatcggcgtgctagaagacgccctgcccttcctgcgcagcctcattgaaaacgagctcaacagcgccaatgacaatcccatcatcgatggcgaaggtggccatgtcctgcacggcggccatttctatggcggccacatcgcctttgccatggactccctcaaaaacgctgtggccaacctggccgatctcatggaccgtcaggttgcccagcttctcgaccccaaattcaaccacggcctgcctgccaacttgtccggctctcctttggcccgcgccagcatcgatcacggcctcaaggccctgggtatcggtacctcagcctgggctgccgaggcactcaagctgaccatgccagcctctgtcttctcccgctccacagaaagccataaccaggacaaagtctccatgggcaccatcgcctcccgcgactgcctgcgcgtgctggccctgaccgagcaggtcgccgcaggcgccctcttagccgtcacccaaggcttggaactgcgcaccaaaaaagacggcaaagttcccagccccgccttgaaggccatgcaagcagaagtgcgcaagcacagccccagcctggaagaggaccgccgcttggaccacgagctacgcgcgctttgcggcctcatccgcagccgcgcctgggcactctacgagggaaactga

SEQ ID NO: 116 - protein, 516 aa, Unknown
  Obtained from environmental sample
  DOMAIN (5)...(490): Phenylalanine and histidine ammonia-lyase
MSKPKITFSRNALSIEDVVALAEAKAEASLETQADFKAYVSRGADFLDKLLEEDGVIYGVTTGYGDSVTVAVPASLVAELPQHLYTFHGVGLGAMLGAQESRAVLAVRLATLCKGRSGVSYALLQQLESLLKNDILPAIPEEGSVGASGDLTPLSYVAAVLCGDREVLASPDGLKLSPASEALKKHGLQPHKLRPKEGLAVMNGTAVMTALACLAFKRADYLSRLSTRISAMAVEAMAGNPQHFDETLFSVKPHPGQQRIASRLRSDLGDAVTVKRNEGRLQDRYSLRCSPQVIGVLEDALPFLRSLIENELNSANDNPIIDGEGGHVLHGGHFYGGHIAFAMDSLKNAVANLADLMDRQVAQLLDPKFNHGLPANLSGSPLARASIDHGLKALGIGTSAWAAEALKLTMPASVFSRSTESHNQDKVSMGTIASRDCLRVLALTEQVAAGALLAVTQGLELRTKKDGKVPSPALKAMQAEVRKHSPSLEEDRRLDHELRALCGLIRSRAWALYEGN

SEQ ID NO: 117 - DNA, 1551 bp, Unknown
  Obtained from environmental sample
atgaccctggaaatccacttcggcgacgccgatctaacaatcgaggacgtctggcgcatcgcgggacgcgtagccgtgccgcttctttcggaaaaggacgatgtccgcaatcgcatcacgcggtccgccgagaccgtccggcgtacaatcgccgagggacatgtcatctatggcgtgacgaccggttatggagattcctgcgagacagagatttcccctgccctgatcggggaattgccgcttcatctgacgcgctatcatggctgtggcaccggacgttttcttgacgccgaagaaactcgggccgcgatggccgtgcgccttgccagtcttgttcgcggatggtcgggggtgacgctcgacctcgttcagcttctcgcagagatgttacggctcgatattctccccctcattccatccgaagggtccgtgggagcgagcggcgatctgacacctctcagctatatcgcgggcgccctgacaggcgagcgtcgcgttcgcttccgcggcgcggaaatggatgcttctgcagcgttcgtagaaacggggctcaagccggtcaagcttcgcccgaaagaggcgctcgccatcatgaatgggacggcggtcatgtcgggcctcgctgtcctcgcgttcaagcgtggcgagtatctgtcccaccttgcatcgcgtctgacggcgatggcgtctctcgcgcttctcggcaacccacagcacttcgacgcccgtctcgccggagcaaagccgcatcccggacagatggaagccaccgcccgcatccgtgccgatctggcaagctacgctgaaacggcggaggcggatcgtcttcaggatcgttactctatccgttgcgcgccgcacgtcatcggcgtgctggaagatatgctgccctcgttccgccggcttatcgagaccgagatcaacagcgcgaacgacaatccgctattcgatcccgaagacggccgcactttgcacggcggccacttctatggcggccacatcgcgttcgcgatggatgggttgaagacactggtcgcaaatgttgccgacctcatggaccgtcagctcgccctgctcgtcgatacgcgctacagcaacgggctgccacccaatctctctggctccaaagggccacgcagcgcgatcaatcatggcctcaaagcagttcagatcggcgcctccgcctggaccgcggaagcgctgaaactcacgatgcctgcgagcgtcttctcgcgctctaccgagtgccacaatcaggacaaggtctcgatgggcacgattgcggcgcgcgacgcccttcgcgtcctcgaactcaccgaacaggtcgcggcggcccatctaattgcctgcgttcaggctttgcgtatccgtgagcgtgaaggccaactcaaccaggccacaatcggtccgaggatcgcgcgtttcctcgccgaactcggaactacgattccattcatcgatgaagacaggactctcgatgcgttgcttgcggcgctttgctctgcgatcgtaggccgaaccttcgctatcgacggactggaagtctcatga

SEQ ID NO: 118 - protein, 516 aa, Unknown
  Obtained from environmental sample
  DOMAIN (4)...(485): Phenylalanine and histidine ammonia-lyase
MTLEIHFGDADLTIEDVWRIAGRVAVPLLSEKDDVRNRITRSAETVRRTIAEGHVIYGVTTGYGDSCETEISPALIGELPLHLTRYHGCGTGRFLDAEETRAAMAVRLASLVRGWSGVTLDLVQLLAEMLRLDILPLIPSEGSVGASGDLTPLSYIAGALTGERRVRFRGAEMDASAAFVETGLKPVKLRPKEALAIMNGTAVMSGLAVLAFKRGEYLSHLASRLTAMASLALLGNPQHFDARLAGAKPHPGQMEATARIRADLASYAETAEADRLQDRYSIRCAPHVIGVLEDMLPSFRRLIETEINSANDNPLFDPEDGRTLHGGHFYGGHIAFAMDGLKTLVANVADLMDRQLALLVDTRYSNGLPPNLSGSKGPRSAINHGLKAVQIGASAWTAEALKLTMPASVFSRSTECHNQDKVSMGTIAARDALRVLELTEQVAAAHLIACVQALRIREREGQLNQATIGPRIARFLAELGTTIPFIDEDRTLDALLAALCSAIVGRTFAIDGLEVS

SEQ ID NO: 119 - DNA, 1545 bp, Unknown
  Obtained from environmental sample
atgacgacgccaacccatgagccggtaaccttcggcgaacgccctttgcgcatcgaagacgtgctggccctggccaaccgtcaggcgcccgtgcagttgcagagcgacgccgactaccgtgaacgcatcgccaagggcgcgcggttcctcgattcgctgctggacaaggaaggcgtgatctacggcgtgaccaccggttacggcgactcctgcgtggtggcggtgccgctgcatcacgtcgaagcgctgccgcagcatctctacaccttccacggttgtggactgggcaaactgctcgacgcccaggccacccgcgcagtgctggcggcgcgtctgcagtcgctgtgccacggcgtgtccggggtgcgcatcgagctgctggaacgcctgcatgccttcctcgaacacgacatcctgccgctgatccccgaagagggttcggtaggcgccagcggcgatctgacgccgctgtcctacgtcgccgcgaccctctccggcgagcgtgaagtgatgttccgtggcgagcgccgccaggctgccgatgtgcatcgtgaactgggctggaccccgctggtgctgcgcccgaaagaagcgctggcactgatgaacggcaccgccgtgatgaccggcctcgcctgcctggcctacgcccgcgccgattacctgctgcaactggccacccgcatcaccgcgctgaacgtggtggcgctgcaaggcaatccggagcacttcgacgagcgcctgttcgccgccaagccgcatccggggcagatgcaggtcgccgcgtggctgcgcaaggatctggcgatcgacgcgccgaccgcgccgctgcatcgtctgcaggatcgctattcgctgcgttgcgcaccgcacgtgctcggcgtattggccgacagcctgaactggctgcgttcgttcatcgagaccgaactcaacagcgccaacgacaacccgatcatcgacgccgaagccgagcgcgtgctgcacggcgggcacttctacggcggacacatcgcgttcgccatggacggcctgaaaaaccttgtggccaacgtcgccgacctgcttgaccgccaactcgcactgctggtggacgagcgttacaaccacggtttgccgagcaacctgtccggcgccagcgcggatcgggcgatgctcaaccacggcttcaaggccgtgcagatcggcgccagcgcctggaccgccgaagcgttgaaaaacaccatgccggccagcgtcttctcacgctccaccgagtgccacaaccaggacaaggtgagcatgggcaccatcgccgcccgcgacgccattcgcgtgctggagctgaccgaacaggtggccgccgccacgctgctcgcggccaatcagggtgtgtggctgcgtggccgtgatgaagacgcacgaccactgcctccgtcgctggccgcgatgcacgaagcgctggccaaagacttcccgccggtgatcgaagaccgcgccctggaaggcgaactgcgcctgtgcctgcaacgtatcgccgaacaacactggaggctgcatgcgtag

SEQ ID NO: 120 - protein, 514 aa, Unknown
  Obtained from environmental sample
  DOMAIN (8)...(486): Phenylalanine and histidine ammonia-lyase
MTTPTHEPVTFGERPLRIEDVLALANRQAPVQLQSDADYRERIAKGARFLDSLLDKEGVIYGVTTGYGDSCVVAVPLHHVEALPQHLYTFHGCGLGKLLDAQATRAVLAARLQSLCHGVSGVRIELLERLHAFLEHDILPLIPEEGSVGASGDLTPLSYVAATLSGEREVMFRGERRQAADVHRELGWTPLVLRPKEALALMNGTAVMTGLACLAYARADYLLQLATRITALNVVALQGNPEHFDERLFAAKPHPGQMQVAAWLRKDLAIDAPTAPLHRLQDRYSLRCAPHVLGVLADSLNWLRSFIETELNSANDNPIIDAEAERVLHGGHFYGGHIAFAMDGLKNLVANVADLLDRQLALLVDERYNHGLPSNLSGASADRAMLNHGFKAVQIGASAWTAEALKNTMPASVFSRSTECHNQDKVSMGTIAARDAIRVLELTEQVAAATLLAANQGVWLRGRDEDARPLPPSLAAMHEALAKDFPPVIEDRALEGELRLCLQRIAEQHWRLHA

SEQ ID NO: 121 - DNA, 1548 bp, Unknown
  Obtained from environmental sample
atgccatcccccaacactgaccccatcgtttttgacggcagccgcctgaccatagaagatgtggtggtcctggcgcgccgggaccgtgcagcccagctgtcgcccgaccccgcgtttcgcgcccgtattgcgcgtggtgcagagtttctggaccgcctgctggctgaagatggcgtcatctacggggtgaccaccggctacggcgactcgtgcaccgtcaccattccccctgcattggtcaacgagctgccgcaccacctgtacgcgtaccacggctgcggcctggggcggtttctggcgccggacgaaacacgtgcggtgctggccacccgcctggcgtcgctggcgcgcggcatatcaggcgtcagcgtaggcctgctggagcagattgaggctttgctgcggcacgatgtgctgcccttgattccagccgaaggctcggtgggcgccagcggcgatttgacgcccttgtcctacctggccgcagccttgtgcggcgagcgcgatgtgctgttcaagggcgaggtgcggcccgccgcccaggtgctggccagcctgaacatcacaccgctgcgtctgcggcccaaggaagggctggccatcatgaatggtacggcggtgatgacagcattggcctgcctggcatggcaaaaggccagctacatcagccaactggcgacgcggctgactgcgatgaacgtgctggccagcgcgggcaatgcccaccattttgatgagacgctgttctcggtcaagcctcatgcgggccagcaacaggtggctgcccgtgtgcgcaccgatctggcttgcgaccagcccagccgcaacgagcagcgcctgcaagaccgttactcgctgcgttgcgcgccgcacgtcatcggcgtgctggaagatgcactgcctttcttccgcacgcagattgaaaacgaactcaacagcgcgaatgacaacccgattgtggacgccgacaacgaacgcgtgctgcacggcggccatttctacggcggccgtattgcatttgcaatggatgggttgaagaacgcggtggccaacgtggccgacctgttggaccgccaattggcactcttggtggacacccgcttcaaccacggcctgcccagcaacctgtcggcggcaaccggcccgcgcgcggccatcaaccatggcttgaaggcgctgcagatcagcgtgtccgcatggaccgccgaagcgctgaagctcaccatgcccgcatcggtgttcagccgctccaccgaatgccacaaccaggacaaggtcagcatgggcaccattgccgcacgcgattgcctgcgcgtgctggagttgaccgaacaggtggttgccgccatgttgattgccgcacgccagggcattgccttgcgccaacgtgatcacagcggtgttacgctgcccgcagcactggccagcatgcaggcagaccttgcggagcgcatcccattggtgacggaagaccgcgcgctggaccacgatttgctggccttgctgcaagccatccgcggcgaggcgtggagcctgtatgaagcctga

SEQ ID NO: 122 - protein, 515 aa, Unknown
  Obtained from environmental sample
  DOMAIN (8)...(486): Phenylalanine and histidine ammonia-lyase
MPSPNTDPIVFDGSRLTIEDVVVLARRDRAAQLSPDPAFRARIARGAEFLDRLLAEDGVIYGVTTGYGDSCTVTIPPALVNELPHHLYAYHGCGLGRFLAPDETRAVLATRLASLARGISGVSVGLLEQIEALLRHDVLPLIPAEGSVGASGDLTPLSYLAAALCGERDVLFKGEVRPAAQVLASLNITPLRLRPKEGLAIMNGTAVMTALACLAWQKASYISQLATRLTAMNVLASAGNAHHFDETLFSVKPHAGQQQVAARVRTDLACDQPSRNEQRLQDRYSLRCAPHVIGVLEDALPFFRTQIENELNSANDNPIVDADNERVLHGGHFYGGRIAFAMDGLKNAVANVADLLDRQLALLVDTRFNHGLPSNLSAATGPRAAINHGLKALQISVSAWTAEALKLTMPASVFSRSTECHNQDKVSMGTIAARDCLRVLELTEQVVAAMLIAARQGIALRQRDHSGVTLPAALASMQADLAERIPLVTEDRALDHDLLALLQAIRGEAWSLYEA

SEQ ID NO: 123 - DNA, 1566 bp, Unknown
  Obtained from environmental sample
atgcgaaccgacgagaatcaaaaaacgcgccgaaccctctgctttgacgaccggcgtttgcgcatcgaagatattgtcgatatcgcggcggggaccgtttctgtcgaactttccgcagctccggggtttcgcgcccgcattgcccgtggcgccgactttctcgatcgcttgatccgcgatgaaggtgcggtgtacggcgtgaccactggctttggtgactcctgtgaagtcacggtgccgcccgaattgatccatgagttgccgagccatctttatacttatcgtggctgcggcttaggggagccattcaccgtagaacaaacccgcgctgtaaccgcgacccgcctggtttcgctgcgcaaaggcttttccggtgtcagtgtcgagttgctggaacagctgacgcggcttttgcaaactgatttgatgccggtcatgccgagcgaaggctcggtcggcgcgagcggcgatctaaccccgctttcctatctcaccgcggtgttatgcggtgagggtgaagtatggcgcgctggggttcggagcgccgccgcggaagctttcaccgatgcccgtatcaagccgctccagctgcgccccaaagaaggacttgcggtgatgaacggcacggcggtgatgacggggttagcctgcctagctttcgctcgcgccgaatatctcgtcaggttggccacacgcatcaccgcgatggcgtcctttgccctcgatggcaacgcgcatcacttcgacgctgctttgttcgacgttaaaccgcacgccgggcagcaacaggtggccgcatggctgcgccacgatttgcagggcttgcagggcgagcaggcggggcaaaacggcaaacgattgcaggatcgttactcgatccgctgcgcacctcacgtgatcggcgtgctcgccgacgccttgccctggctgcgccaatcgaatgaaaacgagttaaacagcgccaatgacaatccgatcatcgacgcagccggcgaaagagtgctctacggcggccatttttacggcggtcatatcgcgttcgcgatggatagtatgaaaaacccggtggccaatatcgccgacctgctcgaccggcagatggcgctgctcgtcgacgcccgttacaataacggccttcccgccaatttatcgggcgctaccggcgcgcgggcggcgatcaatcatgggctcaaggcgttgcagatcagcgcgtcggcatggacggccgaagcgcttaagttgaccatgcccgcttcggtattttcccgttccaccgaatgtcacaaccaggacaaagtaagcatgggaaccatagccgcgcgcgacagtgtgcgcgtgttggagctgaccgagcaggtcgccgccgcgttgttaataaccgttcgccaaggtgtgtggttgcgtgcgaagaccgtgggtgcggcaactctgcaagctccgctcatagcgatgctcgagagtttggccgctcatatcgcggtcattgaggaagaccggaaactagagccagatctacggttgttgttggcgcgtatttccagccgggcatggaagctctatgagtaa

SEQ ID NO: 124 - protein, 521 aa, Unknown
  Obtained from environmental sample
  DOMAIN (12)...(494): Phenylalanine and histidine ammonia-lyase
MRTDENQKTRRTLCFDDRRLRIEDIVDIAAGTVSVELSAAPGFRARIARGADFLDRLIRDEGAVYGVTTGFGDSCEVTVPPELIHELPSHLYTYRGCGLGEPFTVEQTRAVTATRLVSLRKGFSGVSVELLEQLTRLLQTDLMPVMPSEGSVGASGDLTPLSYLTAVLCGEGEVWRAGVRSAAAEAFTDARIKPLQLRPKEGLAVMNGTAVMTGLACLAFARAEYLVRLATRITAMASFALDGNAHHFDAALFDVKPHAGQQQVAAWLRHDLQGLQGEQAGQNGKRLQDRYSIRCAPHVIGVLADALPWLRQSNENELNSANDNPIIDAAGERVLYGGHFYGGHIAFAMDSMKNPVANIADLLDRQMALLVDARYNNGLPANLSGATGARAAINHGLKALQISASAWTAEALKLTMPASVFSRSTECHNQDKVSMGTIAARDSVRVLELTEQVAAALLITVRQGVWLRAKTVGAATLQAPLIAMLESLAAHIAVIEEDRKLEPDLRLLLARISSRAWKLYE

SEQ ID NO: 125 - DNA, 1548 bp, Unknown
  Obtained from environmental sample
atgctcaaaacgaaccctgatccggtgcgcttcgatggcagtcgcatcgctatcgaagacatactcgcgctggcgaacagagtacgcgagccgcaactttcgaccgatgcggcttttcgcggacgtatcgcacggggtgcggagttcttggagaagctgctggccgaagaaggcgtcatttatggcgtgaccacgggctacggtgattcctgtacggtgaccatcccaccggaactggtggcggagttgccacatcacctctatgcctatcacgggtgtggaaccggccgcctgcttaccgcagaagaaacgcgcgccgtgttagctgtgcgcctggcttccctggcacagggcatgtccggcgtgagcaacggccttctggaacagatcgaactgttgctgaagcatgatgtcctgccactcattccttcagagggttcggtaggcgccagtggagacttgacaccgttgtcctatttggccgctgttctgtgcggcgaacgcgaggtgtattaccaaggccaccgaaaaaaggcggccgacgtacttgccgtgttgaacgtggcgccgctcagactccgtccgaaggaagggctcgccatcatgaatggcacggccgtcatgacggctctcgcgtgcatcgcttggcagcgggccgattatctgtgccgcctggcaagccgccttaccgccatgaatgtcgtcgccagcgctggcaatgcccatcacttcgacgaagcacttttcgccgtgaaaccgcatgcgggccagcagcgtatcgccactcgtattcgcgaggatttagccggtgaccaacccacccgtaatgaaaagcgcctgcaggaccgctattcgcttcgctgcgcgcctcatgtcatcggtgtgctggaagatacactgccgttcttacgcactttgattgaaaacgaattgaatagtgccaacgacaatccgatcatcgaccccgatggggagcgcgtcttgcatggggggcacttctatggtgggcacattgccttcgcgatggatagcttgaagaatttggtggcgaatgtttccgacctgcccgaccggcaactggcattgctagtcgatacgcggttcaatcatggcctacctgcaaatttgtcgggagcggatggcgctcgggctccaatcaaccatgggctgaaggctttgcaaatcagcgtttctgcgtgggccgccgaagccttgaagctaaccatgcccgcctcggttttttcccggtccacggaatgccataaccaggacaaggtcagtatgggcacgatcgcagcgcgggattgcctgcgtgtgcttgaattgagtgagcaggtacttgccgccatgctgattgctgcgcgccagggagtggccttgcgtgcacgtattgacgacaagctggtgctcggggaggcgctcgcgcagatgcaggccgatctggaaaagcgaatcccgctgatcgaggaagatcgggcgctcgacggagacctgcaccgcctgctggccgatatccgtgtccaggcgtggagactatatgaaacctaa

SEQ ID NO: 126 - protein, 515 aa, Unknown
  Obtained from environmental sample
  DOMAIN (8)...(486): Phenylalanine and histidine ammonia-lyase
MLKTNPDPVRFDGSRIAIEDILALANRVREPQLSTDAAFRGRIARGAEFLEKLLAEEGVIYGVTTGYGDSCTVTIPPELVAELPHHLYAYHGCGTGRLLTAEETRAVLAVRLASLAQGMSGVSNGLLEQIELLLKHDVLPLIPSEGSVGASGDLTPLSYLAAVLCGEREVYYQGHRKKAADVLAVLNVAPLRLRPKEGLAIMNGTAVMTALACIAWQRADYLCRLASRLTAMNVVASAGNAHHFDEALFAVKPHAGQQRIATRIREDLAGDQPTRNEKRLQDRYSLRCAPHVIGVLEDTLPFLRTLIENELNSANDNPIIDPDGERVLHGGHFYGGHIAFAMDSLKNLVANVSDLPDRQLALLVDTRFNHGLPANLSGADGARAPINHGLKALQISVSAWAAEALKLTMPASVFSRSTECHNQDKVSMGTIAARDCLRVLELSEQVLAAMLIAARQGVALRARIDDKLVLGEALAQMQADLEKRIPLIEEDRALDGDLHRLLADIRVQAWRLYET

SEQ ID NO: 127 - DNA, 1578 bp, Unknown
  Obtained from environmental sample
atgaagagcgctgagaatttgagccctggcggcaccaccaaccgaaataatgcaggtcaggtagttatcgaccagtcctgcgtacagattgccgatatcgtggcgcttgcgcagcagtccgcaacgctgaccctgtcgtcgcagccggaatttttggccgcgattacgcgcggcgccgactttctggataggttgctggccgaagacggcattatctatggcgtgactacgggctacggtgattcctgtaccgttgccgtgccgccggaactggtcaacgaactgccgcagcatttatacacctaccatggctgtggcctgggacagtatttcagcgcggcacagacccgcgccgtgatggcggtgcgcctgacttcgctgtgcaagggatattccggtgtcagcgttgatttgctggagcagattacccatctggtgaatcacgatatcctgccgctgatcccgtctgaaggatcggtaggcgccagtggtgatctgacgccgctttcgtatctggcagcggtactgtgcggcgagcgtgaagtcatctacaagggacagcagaccagcgcagcactggcgctggaagccacaggacgaaaaccgttgaagttacgccccaaagaagggctggccatcatgaacggtacagcagtcatgacggcgctggcctgcctggcctatgatcgtgccgattacctgaccaggctgtgtacccgtatcaccgccatggcctcggtggcgctggacggtaatccgaatcatttcgacgccaccctgttttcagtcaagccgcatccgggcatgcaacaggtggcagcctggttgcgtgcagatctgccctctgcacaggtcgagcgcaatggcaagagattgcaggaccgctattcaatacgttgtgcgccccatgtgataggcgtactggcagacgccttgccgctgtttaagtccatgatagaaaacgaactcaacagcgccaacgacaatccgattatcgatgccgaaggcgaacatgtactgcacggcggccatttctacggcgggcatattgcctttgtgatggacagtatgaaaaacacggtcgccaatctggccgacctgctcgaccggcaaatggccttgctggtggatagtcgttacaaccacgaactgccgtccaatctgtccggtgcaacgggcgaacgttcggccatcaatcatggtttaaaggctttgcagatcagcgcttcggcctggactgccgaggcattgaagctgaccatgccggcatcggtattttcccgctctaccgaatgccacaaccaggacaaggtcagtatgggaacaatcgctgcgcgtgactgtatccgtgtattggaactgaccgagcaggttgtggcggcgttactgattacggtgcgccagggcgttttcctgcgcgcccggcaacagcctacggaattggctccgaatttgcaggaaatgatggcaatgttgagcgctgatattccggaaatcattgaagaccggcgactggaaccggatttgcgctgcatgctggaacgtatccgccagcagcactggacactgtatgagtaa

SEQ ID NO: 128 - protein, 525 aa, Unknown
  Obtained from environmental sample
  DOMAIN (20)...(501): Phenylalanine and histidine ammonia-lyase
MKSAENLSPGGTTNRNNAGQVVIDQSCVQIADIVALAQQSATLTLSSQPEFLAAITRGADFLDRLLAEDGIIYGVTTGYGDSCTVAVPPELVNELPQHLYTYHGCGLGQYFSAAQTRAVMAVRLTSLCKGYSGVSVDLLEQITHLVNHDILPLIPSEGSVGASGDLTPLSYLAAVLCGEREVIYKGQQTSAALALEATGRKPLKLRPKEGLAIMNGTAVMTALACLAYDRADYLTRLCTRITAMASVALDGNPNHFDATLFSVKPHPGMQQVAAWLRADLPSAQVERNGKRLQDRYSIRCAPHVIGVLADALPLFKSMIENELNSANDNPIIDAEGEHVLHGGHFYGGHIAFVMDSMKNTVANLADLLDRQMALLVDSRYNHELPSNLSGATGERSAINHGLKALQISASAWTAEALKLTMPASVFSRSTECHNQDKVSMGTIAARDCIRVLELTEQVVAALLITVRQGVFLRARQQPTELAPNLQEMMAMLSADIPEIIEDRRLEPDLRCMLERIRQQHWTLYE

SEQ ID NO: 129 - DNA, 1533 bp, Unknown
  Obtained from environmental sample
atgcaagttttagttattggggaacatccactttcaattgaagatgtggtggcagtcgcgcgtcaggaaaaacgcgtggctttaccggactcgaatgagtggcacaatttgattcagcgcggtgccgattttctggatcaactattgcaggatgaaggcgtgatttatggcgtgaccaccggttatggcgattcctgtctggtggaaattcctgcgcatcaggtcaatgaactgcctttgcatttatcgcgtttccatggctgtggtctgggacaaaatctggatttaattagcgcacgtgcagtggtggtgacacgtctatgttcgctggcacgcggttattccggggtttcgcatgcactgctggaacgtctggtgtggatgttaaatgaaaacgtgattccggtgattccctctgaaggttcggtgggggccagtggcgatttaacgccattatcttatattgccggcgcattggtcggtgagcgcgatgtgtatgatcagggacagattgttccggtcagtcaggtctatgcagaaaaaggcctagaacccctagtgatgcgtcccaaagaaggcttggcgctgatgaacggtacagcagtgatgaccgcaattgcctgcctgaactataaaaaagccgaacagatcagcttggccagtacctgtattaccgcgctgaatgtattggccttagaaggtaatccgagccattttgatgaagtgctttttgcgcaaaaaccgcatccgggccagcaacatattgccgcacagctgcgtgactggctgaacagtgaagtacagactgaacatcaaagttcacgcctgcaggaccgttattcgctacgctgcgccccgcatattattggcgtatttgaagattctaaagtatggctgcgccagtttattgaaatgaaattaatttccagtaatgacaatccattgattgatccggtgaatttacgcgtattgcacggcgagcatttctatggtgaccatattgcccaggccatggacagtctgaaaatcatgattgccaatattgccgatttaatggaccgtcaattggcgcaactggtggactataaaatgaataatggtttaccgcgtaatctgactggggcaaccgacgagcgcttaccgttgaaccatggctttaaggcggtgcagattggcgtgtcggcatggaccgcggaagccttgaaacaaaccctttctgcttcgattttctcgcgctcgactgaatgtcataaccaggacaaggtcagcatgggtaccattgccgcacgcgatgccagccgtgtgattgtactgaccgaacaggtgattgcggccctgtgctgtgccagtgtgcaagccattcatttaaaaactctggatggaaaattgtctgaagtcctcgccacatttaaggcttgggtcttgcagacttttgactatgtggtggaagatcggccattgcagcatgagttgcagcaattggtggatcgactggaaaatctgcaattattgaacagtggacttgttcgctaa

SEQ ID NO: 130 - protein, 510 aa, Unknown
  Obtained from environmental sample
  DOMAIN (2)...(487): Phenylalanine and histidine ammonia-lyase
MQVLVIGEHPLSIEDVVAVARQEKRVALPDSNEWHNLIQRGADFLDQLLQDEGVIYGVTTGYGDSCLVEIPAHQVNELPLHLSRFHGCGLGQNLDLISARAVVVTRLCSLARGYSGVSHALLERLVWMLNENVIPVIPSEGSVGASGDLTPLSYIAGALVGERDVYDQGQIVPVSQVYAEKGLEPLVMRPKEGLALMNGTAVMTAIACLNYKKAEQISLASTCITALNVLALEGNPSHFDEVLFAQKPHPGQQHIAAQLRDWLNSEVQTEHQSSRLQDRYSLRCAPHIIGVFEDSKVWLRQFIEMKLISSNDNPLIDPVNLRVLHGEHFYGDHIAQAMDSLKIMIANIADLMDRQLAQLVDYKMNNGLPRNLTGATDERLPLNHGFKAVQIGVSAWTAEALKQTLSASIFSRSTECHNQDKVSMGTIAARDASRVIVLTEQVIAALCCASVQAIHLKTLDGKLSEVLATFKAWVLQTFDYVVEDRPLQHELQQLVDRLENLQLLNSGLVR

SEQ ID NO: 131 - DNA, 1533 bp, Unknown
  Obtained from environmental sample
atgcaagttttagttattggggaacatccactttcaattgaagatgtggtggcagtcgcgcgtcaggaaaaacgcgtggctttaccggactcgaatgagtggcacaatttgattcagcgcggtgccgattttctggatcaactattgcaggatgaaggcgtgatttatggcgtgaccaccggttatggcgattcctgtctggtggaaattcctgcgcatcaggtcaatgaactgcctttgcatttatcgcgtttccatggctgtggtctgggacaaaatctggatttaattagcgcacgtgcagtggtggtgacacgtctatgttcgctggcacgcggttattccggggtttcgcatgcactgctggaacgtctggtgtggatgttaaatgaaaacgtgattccggtgattccctctgaaggttcggtgggggccagtggcgatttaacgccattatcttatattgccggcgcattggtcggtgagcgcgatgtgtatgatcagggacagattgttccggtcagtcaggtctatgcagaaaaaggcctagaacccctagtgatgcgtcccaaagaaggcttggcgctgatgaacggtacagcagtgatgaccgcaattgcctgcctgaactataaaaaagccgaacagatcagcttggccagtacctgtattaccgcgctgaatgtattggctttagaaggtaatccgagccattttgatgaagtgctttttgcgcaaaaaccgcatccgggccagcaacatattgccgcacagctgcgtgactggctgaacagtgaagtacagactgaacatcaaagttcacgcctgcaggaccgttattcgctacgctgcgccccgcatattattggcgtatttgaagattctaaagtatggctgcgccagtttattgaaaatgaattaaattccagtaatgacaatccattgattgatccggtgaatttacgcgtattgcacggcgggcatttctatggtggccatattgcccaggccatggacagtctgaaaatcatgattgccaatattgccgatttaatggaccgtcaattggcgcaactggtggactataaaatgaataatggtttaccgcgtaatctgactggggcaaccgacgagcgcttaccgttgaatcatggctttaaggcggtgcagattggcgtgtcggcatggaccgcggaagccttgaaacaaaccctttctgcttcgattttctcgcgctcgactgaatgtcataaccaggacaaggtcagcatgggtaccattgccgcacgcgatgccagccgtgtgattgtactgaccgaacaggtgattgcggccctgtgctgtgccagtgtgcaagccattcatttaaaaactctggatggaaaattgtctgaagtcctcgccacatttaaggcttgggtcttgcagacttttgactatgtggtggaagatcggccattgcagcatgagttgcagcaattggtggatcgactggaaaatctgcaattattgaacagtggacttgttcgctaa

SEQ ID NO: 132 - protein, 510 aa, Unknown
  Obtained from environmental sample
  DOMAIN (2)...(487): Phenylalanine and histidine ammonia-lyase
MQVLVIGEHPLSIEDVVAVARQEKRVALPDSNEWHNLIQRGADFLDQLLQDEGVIYGVTTGYGDSCLVEIPAHQVNELPLHLSRFHGCGLGQNLDLISARAVVVTRLCSLARGYSGVSHALLERLVWMLNENVIPVIPSEGSVGASGDLTPLSYIAGALVGERDVYDQGQIVPVSQVYAEKGLEPLVMRPKEGLALMNGTAVMTAIACLNYKKAEQISLASTCITALNVLALEGNPSHFDEVLFAQKPHPGQQHIAAQLRDWLNSEVQTEHQSSRLQDRYSLRCAPHIIGVFEDSKVWLRQFIENELNSSNDNPLIDPVNLRVLHGGHFYGGHIAQAMDSLKIMIANIADLMDRQLAQLVDYKMNNGLPRNLTGATDERLPLNHGFKAVQIGVSAWTAEALKQTLSASIFSRSTECHNQDKVSMGTIAARDASRVIVLTEQVIAALCCASVQAIHLKTLDGKLSEVLATFKAWVLQTFDYVVEDRPLQHELQQLVDRLENLQLLNSGLVR

SEQ ID NO: 133 - DNA, 1587 bp, Unknown
  Obtained from environmental sample
atgccgcacattgacccttccagcccggcgccggacgccccggccgtcacctttggcgaacgctggcttcgtatcgaagatctcgtcgccttatcgaagcgcaatgcgcaggcacagctttcgggcgcgcagccgtttttggcccgcatccagcgcggtgccgatttcctggatcggctgctgcgtgaagacggcaccatctatggcgtgaccacgggctatggcgactcctgcaccgtcgtgatcccaccggaattgatcgccgatctgccgcatcatctctacacctatcacggctgtggcctgggtgcagtgttcacacctgagcagacgcgcgcaatcctggcagcccgcctcaactcgctggccaagggctactccggcgtcagcgtcggcttgttgcggcagattgaagcgctgctgcagaacgacctgctgccgctgatcccgagtgaaggatcggtcggcgccagcggcgacctaacaccgctgtcctatgtggcggccgtcctgtgcggcgagcgcgatgtctggcacaaaggtgaacagaagaacgcggcagatgcgctggcgttggcaaacatcacgccgctgcgcctgcgtcccaaggaaggcctggctatcatgaacggtaccgccgtgatgacggcactggcttgcctcgcgtatgaccgtgcgcagtacctgtgccaacttgccacccgcatcaccgccatggcaagcgttgcgctagacggcaatgcccaccatttcgacgccacacttttttcggtcaagccacatccgggcctgcagcaagtcgcggcctggctgcaatcggacttgccttgcggccagccccatcgcaacggaaaacgcctgcaggaccgttactccatccgctgcgcgccgcatgtgatcggcgtattgaccgatgccctgcccggcatgcgcagcgccatcgagaacgaactcaatagcgccaacgacaatccgatcatcgatcctgacaatgagcgcgtgctgcacggcgggcacttctacggcgggcatatcgcgttcgccatggactgcatgaaaaacgccgttgccaatatcgccgacctgcttgaccgccagatggcgctcttggtcgacagccgctacaacaacggcctgccgcccaacttgtcgggtgccagcgggcagcgcgctgcgatcaaccacggcctgaaggccttgcaaatcagcgcctccgcatggacggccgaagcactcaagcagaccatgccggcatccgtcttttcgcgctccaccgaatgccataaccaggacaaggtgagcatgggcactatcgcggcacgcgattgcctgcgtgtgctggagttgaccgaacaagtcgccgcagcgctattggtcaccgtgcgccagggagtagcattgcgcgccggcatggcagcttcgccccaagaaaaccgcttgcaggatctgccgggcgggcggctggctaccatgcaggcggcgctatgcgccgatatcgcgctggtcaccgaagaccgcatgttggaaccggacttgcgcctgctgctccaacgcatccgtacccaagcctggaccttgtatgaatga

SEQ ID NO: 134 - protein, 528 aa, Unknown
  Obtained from environmental sample
  DOMAIN (15)...(493): Phenylalanine and histidine ammonia-lyase
MPHIDPSSPAPDAPAVTFGERWLRIEDLVALSKRNAQAQLSGAQPFLARIQRGADFLDRLLREDGTIYGVTTGYGDSCTVVIPPELIADLPHHLYTYHGCGLGAVFTPEQTRAILAARLNSLAKGYSGVSVGLLRQIEALLQNDLLPLIPSEGSVGASGDLTPLSYVAAVLCGERDVWHKGEQKNAADALALANITPLRLRPKEGLAIMNGTAVMTALACLAYDRAQYLCQLATRITAMASVALDGNAHHFDATLFSVKPHPGLQQVAAWLQSDLPCGQPHRNGKRLQDRYSIRCAPHVIGVLTDALPGMRSAIENELNSANDNPIIDPDNERVLHGGHFYGGHIAFAMDCMKNAVANIADLLDRQMALLVDSRYNNGLPPNLSGASGQRAAINHGLKALQISASAWTAEALKQTMPASVFSRSTECHNQDKVSMGTIAARDCLRVLELTEQVAAALLVTVRQGVALRAGMAASPQENRLQDLPGGRLATMQAALCADIALVTEDRMLEPDLRLLLQRIRTQAWTLYE

SEQ ID NO: 135 - DNA, 1563 bp, Unknown
  Obtained from environmental sample
atgacgcaggttgtttttggccaacacgcattaagcattgaacagatactggcagtggcacaggggcaggccagggctgccttgccggaagacaacgcatggcgtgacataatccagcagggtgcggactttctggatgaactgctgcgtgacgatggggtgatttacggcgtcaccaccggttatggcgactcctgtacggtggccattccgcgtgaactggtgaatgaactgccgcagcatttgttccgcttccatggctgtggccttggcaatgtgctggaccgggtggccgggcgcgcagtactggcggtacggttatgttcgctggcacgcggtttttccggtgtgtcgctggcgttgctggagcgtctggtttggctgctgaatgaagatattgtaccagtgatcccggaagaaggctcggtcggtgccagcggcgatttaacccccttgtcctatgtggcggcggtgctggctggtgagcgcgaggtgtactggcagggccagcgtattgatgccgcgcaggtgtatcagcagttgcaggtacagccactcaccctgcgtcccaaggaaggcctggccatcatgaatggcacggcggtgatgaccgcgctggcctgtattgccttccagcgtgccgagcaggtgagccgggtggccacctgtattacctcaatgaacattctggccatgaacggcaatccctaccactatgacgaagtgctgtttgcgcaaaagccgcatgccggacagcaacaggtggccgcatggattcgtgaggatattgcagcacaaacactggcagaaaaacagtccgcacgcttgcaggaccgttattcgctgcgctgtgcgccacatgtgattggtgtgtttgaggattccaggcagtggttgcgccagctgattgaaaacgagctgaactccagtaacgataatccgctgattgatccggttaatcgccgggtgctgcatggcgggcatttttatggcgggcatattgcccaggccatggatagcctgaagaatatgctggccaacattgccgacctgctggaccgccagctggcacagctggtggatgacaagtttaaccacgatttgccacgcaacctgaccggggcaactggcgcgcgtttgccgctaaaccatggctttaaggccttgcagattgcggtgtccgcctggaccgccgaagcgctgaaaaacaccatgccggcttcggtgttctcgcgttcgaccgaatgccataaccaggacaaggtgagcatgggaaccattgccgcgcgggacgccctgcgggtgctgcaactggtggaacaggtgctggcagccaccctgttaaccggcaagcaggccgtggtcttacgtgccggcctgcaagcagagccactgcattatggcgacgtggtgcagcacacgctggactggatagcggcctcctttgattttctggcagaagaccgcccgctggaagccgatttgcgtcatttgctggcccgtttacaggatctccagctgctcagcctgtatcaggggttacaacaggaactggcgggttaa

SEQ ID NO: 136 - protein, 520 aa, Unknown
  Obtained from environmental sample
  DOMAIN (3)...(484): Phenylalanine and histidine ammonia-lyase
MTQVVFGQHALSIEQILAVAQGQARAALPEDNAWRDIIQQGADFLDELLRDDGVIYGVTTGYGDSCTVAIPRELVNELPQHLFRFHGCGLGNVLDRVAGRAVLAVRLCSLARGFSGVSLALLERLVWLLNEDIVPVIPEEGSVGASGDLTPLSYVAAVLAGEREVYWQGQRIDAAQVYQQLQVQPLTLRPKEGLAIMNGTAVMTALACIAFQRAEQVSRVATCITSMNILAMNGNPYHYDEVLFAQKPHAGQQQVAAWIREDIAAQTLAEKQSARLQDRYSLRCAPHVIGVFEDSRQWLRQLIENELNSSNDNPLIDPVNRRVLHGGHFYGGHIAQAMDSLKNMLANIADLLDRQLAQLVDDKFNHDLPRNLTGATGARLPLNHGFKALQIAVSAWTAEALKNTMPASVFSRSTECHNQDKVSMGTIAARDALRVLQLVEQVLAATLLTGKQAVVLRAGLQAEPLHYGDVVQHTLDWIAASFDFLAEDRPLEADLRHLLARLQDLQLLSLYQGLQQELAG

SEQ ID NO: 137 - DNA, 1533 bp, Unknown
  Obtained from environmental sample
atgcaagttttagttattggggaaagtccactttcaattgaagatgtggtggcagtcgcacgtcaggaaaaacgcgtggctttaccggactcaaatgaatggcgcaatttgattcagcgcggtgctgattttctggatcaactgttgcaggatgaaggcgtgatttatggcgtgaccaccggttatggcgattcctgtctggtggaaattcctgcgcatcaggtcaatgaactgcctttgcatttatcgcgtttccatggctgtggtctgggacaaaatctggatttaatcaccgcacgtgcggtggtggtgacacgcctgtgctcgctggcacgtggctattccggggtttcgcatgcgctgctggaacgtctggtctggatgttaaatgaaaacgtgattccagtgattccctctgaaggttcggtgggggccagtggcgatttaaccccattatcctatattgccggcgcattggtcggtgagcgcgatgtgtatgatcagggacagattgttccggtcagtcaggtttatgcagaaaaaggcctagaacccctagtgatgcgtcccaaagaaggcttggcactgatgaacggtacggcggtgatgaccgcgattgcctgcctgaactataaaaaagctgaacagatcagcttggccagtacctgtattaccgcgctgaatgtcttggctttggaaggtaatccgagccattttgatgaagtgctgtttgcgcaaaaaccgcatccgggccagcaaaatattgccgcacagctgcgtgactggctgaacagtgaagtacagactgaacatcaaagttcacgtctgcaggaccgttattcgctacgctgcgcaccgcatattattggcgtatttgaagattctaaagtatggctgcgccagtttattgaaaatgaactgaattccagtaatgacaatccgctgattgatccggtgaacttgcgtgtgttgcacggcgggcatttctatggcggtcacattgcccaggccatggacagcctgaaaatcatgattgccaatattgccgacctcatggaccgtcagctggcgcaactggtggactataaaatgaataatggtttgccgcgtaatttaactggggcaaccgacgagcgcctaccattgaatcatggctttaaggcggtgcagattggcgtgtcggcatggacggcagaagccttgaaacagaccctttctgcttcgattttctcgcgctcgaccgaatgtcataaccaggacaaggtcagtatgggtaccattgccgcacgtgacgccagccgtgtgatcgtactgaccgaacaggtgattgcggccctgtgctgtgccagtgtacaagccattcatttaaaaactctggatggaaaattgtctgaagttctcgccacatttaaggcctgggtgttacaaacctttgattacgtggtggaagaccggccattgcagcacgagttgcagcaactggcggatcgactggaaaatctgcaattattgaacagtggacttgttcgctag

SEQ ID NO: 138 - protein, 510 aa, Unknown
  Obtained from environmental sample
  DOMAIN (2)...(487): Phenylalanine and histidine ammonia-lyase
MQVLVIGESPLSIEDVVAVARQEKRVALPDSNEWRNLIQRGADFLDQLLQDEGVIYGVTTGYGDSCLVEIPAHQVNELPLHLSRFHGCGLGQNLDLITARAVVVTRLCSLARGYSGVSHALLERLVWMLNENVIPVIPSEGSVGASGDLTPLSYIAGALVGERDVYDQGQIVPVSQVYAEKGLEPLVMRPKEGLALMNGTAVMTAIACLNYKKAEQISLASTCITALNVLALEGNPSHFDEVLFAQKPHPGQQNIAAQLRDWLNSEVQTEHQSSRLQDRYSLRCAPHIIGVFEDSKVWLRQFIENELNSSNDNPLIDPVNLRVLHGGHFYGGHIAQAMDSLKIMIANIADLMDRQLAQLVDYKMNNGLPRNLTGATDERLPLNHGFKAVQIGVSAWTAEALKQTLSASIFSRSTECHNQDKVSMGTIAARDASRVIVLTEQVIAALCCASVQAIHLKTLDGKLSEVLATFKAWVLQTFDYVVEDRPLQHELQQLADRLENLQLLNSGLVR

SEQ ID NO: 139 - DNA, 1566 bp, Unknown
  Obtained from environmental sample
atgcatcccgttgacttgaagaagaactcaaactcagtccgtacgattcacttcgacgatggacggctgaaagtcgaggatattgtcgatattgcggaagggtcggctagggtagcactgtccaatgcttctgaattccgctccgcgattgcgcgaggggcggactttctggaccgtttgctgcgcgaagagggtacgattcatggcgtcaccaccggctacggcgattcatgcaccgtgacagtcccgctggatttggtcgccgagttgccgcgccatctctacacttatcacggttgcgggctgggggagtatttaagtcccgtacagacgcgggccgtgatcgccacccgcctcacgtcgttgtgcaaaggattctctggcgtcagtctcgaactgctgcatcaacttgtgaggttgctgcagtgcgatttattgccattgattccatctgaaggttcggtgggcgccagcggcgatctcaccccactatcttatctcgctgccgtgttgtgcggcgagggcgaagtttggcgcgaaggcgtccatacgagcgccgcgcaggcactggctgaggccggtatcgcaccgctacggttgaggccaaaagaaggactggcgatcatgaatgggacgtcggtcatgaccgctttggcgtgccttgcttatgcgcgcgccgattacctcacccggctagtcactcgcatcaccgcattggcgtcgtttgcgctggacggcaatgcgcaccatttcgaggctacgttgttctcagtgaagccgcacccaggccagcagcgggtggccggttggttgcgtcaagacttggcgtgcgatcagctggaccccaacggaaagcgtctccaggatcgctactcgatccgttgcgcgccccacgtgatcggtgttctcgccgatgcgctgccatggttgcgcgagtccatcgaaaatgaactcaacagcgccaacgataatccgatcatcgacgcggagggcgaacgggtgctctatggcggtcacttctatggggggcatattggatttgtcatggacagcatgaaaaatgccgtcgcaaacctggcggatctgcttgaccggcagatggcgctgctggtcgacagccgctatagcaacggcttgccggccaatttgtctggggttcaagggccacgtgcagcgatcaatcatgggctcaaggggttgcagatcagtgtttcggcatggaccgcggaggccctcaagttgaccatgccggcgtcggtgttctcgcgttcgaccgagtgccacaaccaggacaaagtcagcatgggtaccattgcggcacgcgattgtttgcgtgtgctcgaattgacggagcaagtcgtcgcggcgctgctgatcaccgtgcgacagggagtctggctccgctgcaagctgaatcgatccgtcgctcccgaggcgacgttgaagaacatgatggacaccctgggcgctgatatcgctgagattgaggaggaccgcaggctagagccggatttgcgactactgctggagcgcatccgcgaccgtgtctggaaatcgtatgaataa

SEQ ID NO: 140 - protein, 521 aa, Unknown
  Obtained from environmental sample
  DOMAIN (15)...(494): Phenylalanine and histidine ammonia-lyase
MHPVDLKKNSNSVRTIHFDDGRLKVEDIVDIAEGSARVALSNASEFRSAIARGADFLDRLLREEGTIHGVTTGYGDSCTVTVPLDLVAELPRHLYTYHGCGLGEYLSPVQTRAVIATRLTSLCKGFSGVSLELLHQLVRLLQCDLLPLIPSEGSVGASGDLTPLSYLAAVLCGEGEVWREGVHTSAAQALAEAGIAPLRLRPKEGLAIMNGTSVMTALACLAYARADYLTRLVTRITALASFALDGNAHHFEATLFSVKPHPGQQRVAGWLRQDLACDQLDPNGKRLQDRYSIRCAPHVIGVLADALPWLRESIENELNSANDNPIIDAEGERVLYGGHFYGGHIGFVMDSMKNAVANLADLLDRQMALLVDSRYSNGLPANLSGVQGPRAAINHGLKGLQISVSAWTAEALKLTMPASVFSRSTECHNQDKVSMGTIAARDCLRVLELTEQVVAALLITVRQGVWLRCKLNRSVAPEATLKNMMDTLGADIAEIEEDRRLEPDLRLLLERIRDRVWKSYE

SEQ ID NO: 141 - DNA, 1563 bp, Unknown
  Obtained from environmental sample
atgcccgttgacttgaggaagagctcaacctcagtccgtacgattcaattcgaccgtggacggctgaaaatcgaggatattgtcgatatctcggaagggtcggttcacgtagcactgtccaatgcttctgaatttcgttccgccattgcgcgaggggcggactttttggatcgtctgctgcgcgaagagggcacgatttatggcgtcaccaccggctacggcgattcatgcaccgtggcggtcccgcctgagctggtcgccgagttgccgcgccagctctatgtctatcacggctgtgggctgggcgagtatttgagtccgctacagacgcgggccgtgatcgccacccgcctcgcatcgttgtgcaaaggactctctggcgtcagtctggaactgctgcatcaactcgtgaggttgctgcagtacgatttattgccattgattccatctgaaggttcggtgggggctagcggcgatctcactccgctatcctatctcgctgccgtgttgtgcggcgagggcgaagtttggcgcaacggcgtccatgtaagcgcagcgcacgcactggctgaggccggtatcgcaccgctgcggttgaggccaaaagaaggactggcgattatgaatgggacgtccgtcatgaccgctttggcgtgccttgcttatgggcgcgccgattacctcacgcggctagttactcgcatcacggcattggcgtcgtttgcgctggacggcaatgcgcatcatttcgatgctacgttgttctcagtgaagccgcatccaggccagcagcgggtggccggttggttgcgtcaagacttggcgtgcgatcagctggaccccaacggaaagcgcctccaggatcgctactcgatccgttgcgccccacacgtgatcggtgttctcgccgatgccctgccatggttgcgcgactccatcgaaaatgaactcaacagcgctaacgacaatccgatcatcgatgcggagggcgaacgtgtgctctatggcggtcacttctatggggggcatattggatttgccatggacagcatgaaaaatgccgtcgcaaacctggcggatctgcttgaccggcaaatggcactgctggtcgacagccgctatagcaacggcttgccggccaatttatctaaggttcaagggccacgtgcggcgatcaatcatgggctcaaggggttgcagatcagtacttcggcatggacggcagaagccctcaagttgaccatgccggcgtcagtgttctcgcgttcgaccgagtgtcacaaccaggacaaagtcagcatgggtaccattgcggcacgcgattgtttgcgtgtgctcgaattgactgagcaagtcgccgcggcgctgctgatcaccgtgcgacagggagcctggctccgttgcaggctgaatcgatccgtcgctccagaggcgacgttgaagaacatgatggacgccttgggtgctgatatcgctgagattgaggaggaccgcaggctagagccggatttgcgatcactgctggagcggatccgcgaccgtgcctggaaattgtatgaataa

SEQ ID NO: 142 - protein, 520 aa, Unknown
  Obtained from environmental sample
  DOMAIN (14)...(493): Phenylalanine and histidine ammonia-lyase
MPVDLRKSSTSVRTIQFDRGRLKIEDIVDISEGSVHVALSNASEFRSAIARGADFLDRLLREEGTIYGVTTGYGDSCTVAVPPELVAELPRQLYVYHGCGLGEYLSPLQTRAVIATRLASLCKGLSGVSLELLHQLVRLLQYDLLPLIPSEGSVGASGDLTPLSYLAAVLCGEGEVWRNGVHVSAAHALAEAGIAPLRLRPKEGLAIMNGTSVMTALACLAYGRADYLTRLVTRITALASFALDGNAHHFDATLFSVKPHPGQQRVAGWLRQDLACDQLDPNGKRLQDRYSIRCAPHVIGVLADALPWLRDSIENELNSANDNPIIDAEGERVLYGGHFYGGHIGFAMDSMKNAVANLADLLDRQMALLVDSRYSNGLPANLSKVQGPRAAINHGLKGLQISTSAWTAEALKLTMPASVFSRSTECHNQDKVSMGTIAARDCLRVLELTEQVAAALLITVRQGAWLRCRLNRSVAPEATLKNMMDALGADIAEIEEDRRLEPDLRSLLERIRDRAWKLYE

SEQ ID NO: 143 - DNA, 1563 bp, Unknown
  Obtained from environmental sample
atgctaccaggtgacatgaacagttcaacctcgacccgcaggattacgttcgacaacggaccggtgagaatcgaggacattgtggacatcgcggcagggtccgcaagcgtggcattgtctgatcgttccgaatttcgcgcagccattacccgaggggcggactttctggactgtctggcgcgcgaagagggcacgatctatggcgtcaccaccggctacggcgattcatgcaccgtgacagtcccgctcgagttggtcgccgagctgccacgccatctctatacgtatcacggctgcgggctgggggagtatttaagtccggcacagacgcgtgccgtgatcgcaacccgcctcacgtcactgtccaaaggcttctctggtgtcagtctggaactactggaacagatggtgcggctactgcagtgcgatttattgccattgatcccatctgaaggttcggtgggtgccagcggcgatctaactccgctatcctacctcgccgctgttttgtgcggcgagggtgaagtttggcgcaacggcgtccaggtaggcgccgcgcaggcactgtctgaggccggtatcgcgccgctgcgactacgacccaaagaaggactggccgtcatgaacggaacggccgtcatgacggctttggcgtgcctcgcttacgtgcgcgccgattatattgcccggctagcaacgcgcattaccgcattggcatcgtttgcgctcgacggcaatgcgcaccatttcgatgcgacgctattcgcagtgaagccgcatccaggccagcagcgcgtggccggttggctgcgccgagacctgccgtgcgatcagctggatcccaacggaaagcgcctgcaggaccgctattcgatacgttgcgcgccgcacgtgatcggtgttctcgccgacgctctgccctggttgcgcgagttcatcgaaactgaacttaatagcgccaacgataatccgatcgttgacccggagagcaaaagcgtactatacggcggtcatttttacggtgggcacatcgcgtttgccatggacagcatgaaaaatgccgtcgccaacctggcggatctgatggatcggcagatggcgctactggtggatactcgctacaacaatggtttgccggccaacttgtccggggttcaagggccgcgtgcagcgatcaaccatgggctcaaggcgttgcagatcagcgcgtcggcatggacggcggaagcgctcaagttgaccatgccggcgtcggtgttctcgcgctcgacggaatgccataaccaggacaaggtcagcatgggtacgattgcggcacgcgattgtttgcgggtgctcgaattggtcgagcaagtcgccgcggcgctgctcatcgccgtgcggcagggagtctggctccgttgcagactgaatcggtccgcgcttccggggacaaccttaaagaacatgatggacgcgctgggcgctgatatcagcgtgatcgaggaagatcgtcgacttgaaccggatttgcgtttgctgctggagcggatccgcagccgcgcctggaaactgtatgagtaa

SEQ ID NO: 144 - protein, 520 aa, Unknown
  Obtained from environmental sample
  DOMAIN (14)...(493): Phenylalanine and histidine ammonia-lyase
MLPGDMNSSTSTRRITFDNGPVRIEDIVDIAAGSASVALSDRSEFRAAITRGADFLDCLAREEGTIYGVTTGYGDSCTVTVPLELVAELPRHLYTYHGCGLGEYLSPAQTRAVIATRLTSLSKGFSGVSLELLEQMVRLLQCDLLPLIPSEGSVGASGDLTPLSYLAAVLCGEGEVWRNGVQVGAAQALSEAGIAPLRLRPKEGLAVMNGTAVMTALACLAYVRADYIARLATRITALASFALDGNAHHFDATLFAVKPHPGQQRVAGWLRRDLPCDQLDPNGKRLQDRYSIRCAPHVIGVLADALPWLREFIETELNSANDNPIVDPESKSVLYGGHFYGGHIAFAMDSMKNAVANLADLMDRQMALLVDTRYNNGLPANLSGVQGPRAAINHGLKALQISASAWTAEALKLTMPASVFSRSTECHNQDKVSMGTIAARDCLRVLELVEQVAAALLIAVRQGVWLRCRLNRSALPGTTLKNMMDALGADISVIEEDRRLEPDLRLLLERIRSRAWKLYE

SEQ ID NO: 145 - DNA, 1563 bp, Unknown
  Obtained from environmental sample
atgcccgttgacttgaagaagagctcaacctcagtccgtacgattcaattcgacgatggacggctgaaaatcgaggatattgtcgatatctcggaagggtcggttcgcgtagcactgtccaatgcttctgaatttcgttccgccattgcgcgaggggcggactttttggatcgtctgatgcgcgaagagggcacgatttatggcgtcaccaccggctacggcgattcatgcaccgtggcggtcccgcctgagctggtcgccgagttgccgcgccagctctatgtctatcacggctgtgggctgggcgagtatttgagtccgctacagacgcgggccgtgatcgccacacgcctcacatcgttgtgcaaaggactctctggcgtcagtctggaactgctgcatcaactcgtgaggttgctgcagtacgatttattgccattgattccatctgaaggttcggtgggggctagcggcgatctcactccgctatcctatctcgctgccgtgttgtgcggcgagggcgaagtttggcgcaacggcgtccatgttagcgcagcgcacgcactggctgaggccggtatcgcaccgctgcggttgaggccaaaagaaggactggcgattatgaatgggacgtccgtgatgaccgctttggcgtgccttgcttatgggcgcgccgattacctcacgcggctagttactcgcatcacggcattggcgtcgtttgcgctggacggcaatgcgcatcatttcgatgctacgttgttctcagtgaagccgcatccaggccagcagcgggtggccggttggttgcgtcaagacttggcgtgcgatcagctggaccccaacggaaagcgcctccaggatcgctactcgatccgttgcgccccacacgtgatcggtgttctcgccgatgctctgccatggttgcgcgactccatcgaaaatgaactcaacagcgctaacgacaatccgatcatcgatgcggagggcgaacgtgtgctctatggcggtcacttctatggggggcatattggatttgccatggacagcatgaaaaatgccgtcgcaaacctggcggatctgctcgaccggcaaatggcactgctggtcgacagccgctatagcaacggcttgccggccaatttatctggggttcaagggccacgtgcggcgatcaatcatgggctcaaggggttgcagatcagtacttcggcatggacggcagaagccctcaagttgaccatgccggcgtcagtgttctcgcgttcgaccgagtgtcacaaccaggacaaagtcagcatgggtaccattgcggcacgcgattgtttgcgtgtgctcgaattgactgagcaagtcgccgcggcgctgctgatcaccgtgcgacagggagcctggctccgttgcaggctgaatcgatccgtcgctccagaggcgacgttgaagaacatgatggacgctttgggcgctgatatcgctgagattgaggaggaccgcaggctagagccggatttgcgattactgctggagcggatccgcgaccgtgcctggaaattgtatgaataa

SEQ ID NO: 146 - protein, 520 aa, Unknown
  Obtained from environmental sample
  DOMAIN (14)...(493): Phenylalanine and histidine ammonia-lyase
MPVDLKKSSTSVRTIQFDDGRLKIEDIVDISEGSVRVALSNASEFRSAIARGADFLDRLMREEGTIYGVTTGYGDSCTVAVPPELVAELPRQLYVYHGCGLGEYLSPLQTRAVIATRLTSLCKGLSGVSLELLHQLVRLLQYDLLPLIPSEGSVGASGDLTPLSYLAAVLCGEGEVWRNGVHVSAAHALAEAGIAPLRLRPKEGLAIMNGTSVMTALACLAYGRADYLTRLVTRITALASFALDGNAHHFDATLFSVKPHPGQQRVAGWLRQDLACDQLDPNGKRLQDRYSIRCAPHVIGVLADALPWLRDSIENELNSANDNPIIDAEGERVLYGGHFYGGHIGFAMDSMKNAVANLADLLDRQMALLVDSRYSNGLPANLSGVQGPRAAINHGLKGLQISTSAWTAEALKLTMPASVFSRSTECHNQDKVSMGTIAARDCLRVLELTEQVAAALLITVRQGAWLRCRLNRSVAPEATLKNMMDALGADIAEIEEDRRLEPDLRLLLERIRDRAWKLYE

SEQ ID NO: 147 - DNA, 1566 bp, Unknown
  Obtained from environmental sample
atgcatcccgttgacttgaataagagctcaacctcagtccgtatgattaggttcgacgatggacggctgagaatcgaggatattgtcgatatcgcggaagggtcggctagtgtaacactgtccgatgcttgtgaattccgctccgccattgcgcgaggggcggagtttctggatcgtctgctgcgcgaagagggcacggtttatggcgtaaccaccggctacggtgattcatgcaccgtgacggtgccgcttgagttggtggccgagttgccacgccatctctacacttatcacggctgcgggctgggggagtatttaagtccggtacagacgcgggccgtgatcgccactcgcctcacatcgttgtgcaaaggactctctggcgtcagtctggaactgctgcatcaactcgtgaggttactgcagcacgatttattgccattgattccatctgaaggttcggtgggggccagcggcgatctcaccccgctatcgtacgttgctgcggttttgtgcggcgaaggcgaagtttggcgtaacggtgtccatgtaagcgccgcgcaggcactgcatgaggccgggatgacgccgctccggttgaggccaaaagaaggactggccatcatgaatgggacgtccgtcatgaccgctttggcgtgccttgcttatgcgcgggccgagtacctcacgcggctagtcactcgcatcaccgcattggcgtcgtttgccctggacggcaacgcgcaccattttgatgccaagttattttcggtgaagccgcacccaggccagcagcgggtggcgagttggttgcggcaagacttagcgtgcgatcagctggaccccaacggaaagcgcctccaggatcgctactcgatccgttgtgcgccccacgtgattggtgttctcgccgacgcactgccatggttgcgcgagttcatcgaaaacgaactcaacagcgccaacgacaatccgatcatcgacgcggagggcgaacgcgtgctcaatggcggtcacttctatggggggcacattggatttgccatggacagcatgaaaaatgccatcgcaaacctggcggatctgcttgaccggcagatggcactgctggtcgacagtcgctacaataatgggttgccggccaacttgtctggggttcaaggaccacgtgcagcgatcaatcatggcctcaaggggttgcagatcagtgcttcggcatggactgcggaggcgctcaagttgaccatgccggcgtcggtgttctcgcgttcgacggagtgccacaaccaggacaaagtcagcatgggtaccattgcggcacgcgactgtttgcgtgtgctcgaattgacggagcaagtcgccgcggcgttgctgatcaccgtgcggcagggagtctggctccgttgcaggctgaatcgatccgtcgttcccgaaacaacgttgaagaacatgatggaagccttgggtgcagatatcgttgagatcgtggaagatcgcaggctagagccggatttgcggctagtgctggagcgtatccgtgaccgtgtctggaaattgtatgaataa

SEQ ID NO: 148 - protein, 521 aa, Unknown
  Obtained from environmental sample
  DOMAIN (15)...(494): Phenylalanine and histidine ammonia-lyase
MHPVDLNKSSTSVRMIRFDDGRLRIEDIVDIAEGSASVTLSDACEFRSAIARGAEFLDRLLREEGTVYGVTTGYGDSCTVTVPLELVAELPRHLYTYHGCGLGEYLSPVQTRAVIATRLTSLCKGLSGVSLELLHQLVRLLQHDLLPLIPSEGSVGASGDLTPLSYVAAVLCGEGEVWRNGVHVSAAQALHEAGMTPLRLRPKEGLAIMNGTSVMTALACLAYARAEYLTRLVTRITALASFALDGNAHHFDAKLFSVKPHPGQQRVASWLRQDLACDQLDPNGKRLQDRYSIRCAPHVIGVLADALPWLREFIENELNSANDNPIIDAEGERVLNGGHFYGGHIGFAMDSMKNAIANLADLLDRQMALLVDSRYNNGLPANLSGVQGPRAAINHGLKGLQISASAWTAEALKLTMPASVFSRSTECHNQDKVSMGTIAARDCLRVLELTEQVAAALLITVRQGVWLRCRLNRSVVPETTLKNMMEALGADIVEIVEDRRLEPDLRLVLERIRDRVWKLYE

SEQ ID NO: 149 - DNA, 1542 bp, Unknown
  Obtained from environmental sample
atgacaacacatcagcctgagccggtcattttcggcgagacgcacctgacgatcgagaacgttgtcgcgctgtcacagcaacgcgccaaggcgcacttgcagcatgatgccgactaccgggaaaaaatcgccaaaggtgcgcgattcctcgacacgctgctggataaggaaggtgtgatttacggcgtcaccacaggctatggtgactcctgtgtggttgcggtgccgctgcatcaggtcgaagccctgccacgccacctgtacaccttccatggctgcggcttgggtaaattactcgaacctgacgccacccgcgcggtgctggctgcgcgcctgcaatcactgtgttatggggtttccggggtgcgcatcgaattgctcgagcgtctgcaggcatttctcgaacacgacatcctgccgttgattcctgaagaaggctcggtgggcgccagtggcgacttgacgcctctgtcttatgtcgccgcgactctcagcggtgagcgcgaagtgctctaccaaggccaacgacgcagtgcccgcgaggtgcatgaagaactcggctggacgccgctgaccttgcgccctaaagaggcactggcgttgatgaatggcacggcggtcatgaccgcgctggcgtgcctggcctattcccgcgccgactatttactgcaactggccacgcgtattactgcactgaatgtgatcgcgctggaaggtaacccggaacacttcgaccaacggctgtttgccgccaagccgcatccggggcaaatgcaggtcgccgcctggctacgcgaagacctggcgattaccgggcctacagcagcactgcaccgcctgcaggatcgctactcgctgcgctgcgccccgcacgtactgggcgtgatggccgacagtttgggcctgctgcgtcaatttatcgaaaccgaactcaacagtgccaatgacaacccgctgatcgacgcagagaccgagcgcgtcatgcacggcgggcatttctacggcgggcatatcgcctttgccatggacagcctgaaaaacctggtgggcaacgttgccgatttgctcgatcgccagctcgccctgctggtcgatgttcgctacaaccatggcctgccaagtaatctgtccggcgcacctgccagcagcgcaatgatcaaccatggtttcaaagccgtgcagatcggcgccagcgcctggacggcagaagccttgaaaaacaccatgcccgccagtgtcttttcacgctcaaccgagtgccacaaccaagacaaagtcagcatgggcaccatcgccgcgcgcgatgccttgcgcagtctcgaactgaccgagcaggttgctgccgccaccttgctggcggccaatcagggcgtctggctacgcctgcaaaccagcccgcggcaactgccagagccgctgcaggagatgtgcgagcaactggccctggacttcccgccggtcatacaagaccgcgccctggaaggcgagctaaggctgtgcttgcagcgtattcgcaatcaacactggaggctctatgcgcag

SEQ ID NO: 150 - protein, 514 aa, Unknown
  Obtained from environmental sample
  DOMAIN (7)...(490): Phenylalanine and histidine ammonia-lyase
MTTHQPEPVIFGETHLTIENVVALSQQRAKAHLQHDADYREKIAKGARFLDTLLDKEGVIYGVTTGYGDSCVVAVPLHQVEALPRHLYTFHGCGLGKLLEPDATRAVLAARLQSLCYGVSGVRIELLERLQAFLEHDILPLIPEEGSVGASGDLTPLSYVAATLSGEREVLYQGQRRSAREVHEELGWTPLTLRPKEALALMNGTAVMTALACLAYSRADYLLQLATRITALNVIALEGNPEHFDQRLFAAKPHPGQMQVAAWLREDLAITGPTAALHRLQDRYSLRCAPHVLGVMADSLGLLRQFIETELNSANDNPLIDAETERVMHGGHFYGGHIAFAMDSLKNLVGNVADLLDRQLALLVDVRYNHGLPSNLSGAPASSAMINHGFKAVQIGASAWTAEALKNTMPASVFSRSTECHNQDKVSMGTIAARDALRSLELTEQVAAATLLAANQGVWLRLQTSPRQLPEPLQEMCEQLALDFPPVIQDRALEGELRLCLQRIRNQHWRLYAQ

SEQ ID NO: 151 - DNA, 1545 bp, Unknown
  Obtained from environmental sample
atgacgacgccaacgcttgagccggtaaccttcggcgaactccctttgcgcatcgaagacgtgctggccctggccaaccgtcaggtgccgacgcagttgcaggacgatcctgcgtaccgcgagcgcatcgccaagggtgcgcgattcctcgattccctgctggacaaggaaggcgtgatctatggcgtgaccaccggttacggcgattcctgcgtggtcgcggtgccgctgcatcacgtcgaggcgttgccgcgtcatctgtacacattccacggttgcgggctgggcaaactgctcgacgcccaggccacccgcgcggtgctcgcagcgcgtttgcagtcgctgtgccacggcgtgtccggggtgcgcgtggaattgctggagcgcctgcaagcgttcctcgaacacgacatcctgccgctgatcccggaagagggctcggtaggcgccagcggtgatctgacgccactgtcctatgtcgcggcgaccttgtccggcgagcgcgaagtgatgttccgcggcgaacgtcgccaggccgcggacgtgcatcgcgaactgggttgggaaccgctggttctgcgcccgaaagaagccctggcactgatgaacggcaccgccgtgatgaccggcctcgcctgcctggcctacacccgcgccgattatttgctgcaactggccacccgaatcaccgcgctgaacgtggtcgcgctgcaaggcaatccagagcacttcgacgagcgcctgttcgccaccaaaccgcatccggggcagatgcaagtcgccgcgtggctgcgcaaggacctggcgatcgacgcgccgaccgcgccgctgcatcgcttgcaagaccgctattccctgcgctgcgcgccccacgtgctcggcgtcctggccgacagcctgaactggttgcgctcgtttatcgagatcgaactcaacagcgccaacgacaacccgatcatcgacgccgaagccgggcgcgtactgcacggcgggcatttctacggcggccacatcgcgttcgccatggacagcctgaaaaacctggtggccaacgttgccgacctgctcgaccgtcaactcgcactgttggtggacgagcgttacaaccatggcttgccgagcaatctgtccggcgccacggcggatcgcgcgatgctcaaccacggcttcaaagccgtgcagatcggcaccagcgcctggaccgccgaagcattgaaaaacaccatgccggccagcgtgttctcccgctccaccgaatgccacaaccaggacaaggtgagcatgggcaccatcgccgcccgtgatgcgatccgtgtgctggagctgaccgaacaggtcgccgccgccacgctgctcgccgccaatcagggtgtgtggctgcgcagcaaagctgaagatgcccgcccgttgccacccgcccttgccgccatgcacgaagcgctggccaaggacttcccgccagtcatcgaagaccgcgcactggaaggcgaattgcgcctgtgcctgaaacggattgccgaacaacactggaggctgcatgcgtag

SEQ ID NO: 152 - protein, 514 aa, Unknown
  Obtained from environmental sample
  DOMAIN (8)...(486): Phenylalanine and histidine ammonia-lyase
MTTPTLEPVTFGELPLRIEDVLALANRQVPTQLQDDPAYRERIAKGARFLDSLLDKEGVIYGVTTGYGDSCVVAVPLHHVEALPRHLYTFHGCGLGKLLDAQATRAVLAARLQSLCHGVSGVRVELLERLQAFLEHDILPLIPEEGSVGASGDLTPLSYVAATLSGEREVMFRGERRQAADVHRELGWEPLVLRPKEALALMNGTAVMTGLACLAYTRADYLLQLATRITALNVVALQGNPEHFDERLFATKPHPGQMQVAAWLRKDLAIDAPTAPLHRLQDRYSLRCAPHVLGVLADSLNWLRSFIEIELNSANDNPIIDAEAGRVLHGGHFYGGHIAFAMDSLKNLVANVADLLDRQLALLVDERYNHGLPSNLSGATADRAMLNHGFKAVQIGTSAWTAEALKNTMPASVFSRSTECHNQDKVSMGTIAARDAIRVLELTEQVAAATLLAANQGVWLRSKAEDARPLPPALAAMHEALAKDFPPVIEDRALEGELRLCLKRIAEQHWRLHA

SEQ ID NO: 153 - DNA, 1497 bp, Pseudomonas fluorescens ATCC 13525
ttgcgcattgaagacgtattggccctggccaaccgtcaggtgcccacgcaattgcaggatgatgccgcctatcgccagcgcattgccaagggcgcgcagtttctcgactcgttgctggacaaggaaggcgtgatctatggcgtgaccaccggctacggcgactcctgcgtggtggcggtaccgttgcagcacgtcgaggctttgccgcgtcacctgtacacgttccacgggtgcgggctgggcaagttgcttgacgcccaagccacgcgggctgtgctggcggcgcgtctacagtcgttgtgccacggtgtttccggagtgcgtgtggagttgctggagcgcctgcatgcgttccttgaacacgacgtgctgccgctgatcccggaagaaggctcggtgggcgccagcggtgatctgaccccactgtcgtacgttgctgcgaccctgtccggcgagcgtgaagtgatgttccgaggtgaacgccgccaggccgccgacgtgcaccacgaattgggctgggagccgctggtcttgcgccccaaggaagccctggcattgatgaatggcaccgccgtgatgaccggcctcgcctgcctggccttcgcccgtgccgactacctgctgcaactggccacacgcatcaccgcgttgaacgtggtggcgctgcaaggcaacccggaacacttcgacgagcgcctgttcgccgccaagccgcaccccgggcagatgcaagtcgctgcctggttgcgcaaggacctggcgattgatgcgccgaccgcaccgctgcaccgcctgcaggatcgctattcgctgcgctgcgcgccgcacgtgtttggcgtgttggccgacagcctgaactggctgcgttcgtttatcgaaatcgaactgaacagcgccaacgacaacccgatcatcgacgccgaagaagaacgcgtgctgcacggtgggcacttctacggcgggcatatcgccttcgccatggacagcctcaagaccctggtggccaacgttgccgacctgctcgaccgccagctcgcactgctggtggacgtgcgttacaaccacggcctgccgagcaatctgtccggcgccccggccgaccgcgcgatgatcaatcacggtttcaaggccgtgcagatcggcaccagcgcctggaccgccgaagcgctgaaaaacaccatgccggccagcgtgttctcgcgctccaccgaatgccataaccaggacaaggtgagcatgggcaccatcgccgcccgcgatgcaatccgcgtgctggagctgaccgaacaggttgccgccgcgaccctgctcgccgctaaccagggtgtgtggctacgcgcccaggctgacgatgcacgcgcgctgccgccagctttggccgccatgcatgaagagctggccaaggacttcccgccggtcatcgaagaccgcgcgctggaaggcgaactgcgcctgtgcctcaaacgtatcgccgagcaacactggaggctgcatgcg

SEQ ID NO: 154 - protein, 499 aa, Pseudomonas fluorescens ATCC 13525
  DOMAIN (1)...(471): Phenylalanine and histidine ammonia-lyase
MRIEDVLALANRQVPTQLQDDAAYRQRIAKGAQFLDSLLDKEGVIYGVTTGYGDSCVVAVPLQHVEALPRHLYTFHGCGLGKLLDAQATRAVLAARLQSLCHGVSGVRVELLERLHAFLEHDVLPLIPEEGSVGASGDLTPLSYVAATLSGEREVMFRGERRQAADVHHELGWEPLVLRPKEALALMNGTAVMTGLACLAFARADYLLQLATRITALNVVALQGNPEHFDERLFAAKPHPGQMQVAAWLRKDLAIDAPTAPLHRLQDRYSLRCAPHVFGVLADSLNWLRSFIEIELNSANDNPIIDAEEERVLHGGHFYGGHIAFAMDSLKTLVANVADLLDRQLALLVDVRYNHGLPSNLSGAPADRAMINHGFKAVQIGTSAWTAEALKNTMPASVFSRSTECHNQDKVSMGTIAARDAIRVLELTEQVAAATLLAANQGVWLRAQADDARALPPALAAMHEELAKDFPPVIEDRALEGELRLCLKRIAEQHWRLHA

SEQ ID NO: 155 - DNA, 1542 bp, Unknown
  Obtained from environmental sample
atgacgacgccaacccatgagccggtaaccttcggcgaacgccctttgcgcatcgaagacgtgctggccctggccaaccgtcaggcgcccgtgcagttgcagagcgacgccgattaccgtgagcgcatcgccaagggtgcgcggtttctcgactcgctgctggacaaggaaggcgtgatctatggcgtgaccaccggttacggcgattcctgcgtggttgcggtgccgctgcatcacgtcgaggcgctgccgcgtcatctctacaccttccacggttgcggactgggcaaactgctcgacgcccaggccacccgcgccgtgctggccgcacgtttgcagtcgctgtgccacggcgtttccggggtgcgcattgaactgctggagcgcctgcaagagttcctcgaacacgacatcctgccgctgattcccgaagaaggctcggtgggcgccagcggcgacctgacgccgctgtcctacgtcgccgcgaccctgtccggcgagcgcgaagtgatgttccgtggcgaacgccgacaagcggccgacgtgcatcgcgaactcggctggacgccattggtgctgcgcccgaaagaagcgctggccttgatgaacggcacagcagtgatgactggccttgcctgtcttgcctacgcccgcgccgactacctgctgcaactggccacacgcatcaccgcgctcaacgtggtcgcgctgcaaggcaatccggaacacttcgacgaacgcctgttcgccgccaaaccgcacccggggcaaatgcaggtcgccgcgtggctgcgcaaggatctggcgatcgacgcgccgaccgcgccgctgcatcgcctgcaggatcgctactcgctgcgttgcgccccacacgtgctcggcgtgctggccgacagcctgagctggctgcgttcgttcatcgaaaccgaactcaacagcgccaacgacaacccgatcatcgacgccgaagccgagcgcgtgctgcacggcgggcacttctacggcgggcacatcgcgttcgccatggacagcctgaaaaacctcgtggccaacgtggccgacctgctcgaccgacaactcgcgctgctggtcgacgagcgctacaaccatggtttgccgagcaacctgtccggcgccccggcggatcgcgccatgatcaaccacggcttcaaggccgtgcagatcggcaccagcgcctggaccgccgaagccctgaaaaacaccatgccggccagcgtgttctcacgctccaccgagtgccacaaccaggacaaggtgagcatgggcaccatcgccgcccgcgacgcgatccgcgtgctggagctgaccgaacaggtcgccgctgccacgttgctcgcggctaaccaaggtgtgtggctgcgcggtcgcgatcaggatgcgcgaccgctgccgcccgctctggccgccatgcacgaagcactgggcaaagacttcccgccggtcatcgaagaccgtgcgctggaaggcgaactgcgcctgtgcctgcaacgcatcgccgagcaacactggaggctgcatgcg

SEQ ID NO: 156 - protein, 514 aa, Unknown
  Obtained from environmental sample
  DOMAIN (8)...(486): Phenylalanine and histidine ammonia-lyase
MTTPTHEPVTFGERPLRIEDVLALANRQAPVQLQSDADYRERIAKGARFLDSLLDKEGVIYGVTTGYGDSCVVAVPLHHVEALPRHLYTFHGCGLGKLLDAQATRAVLAARLQSLCHGVSGVRIELLERLQEFLEHDILPLIPEEGSVGASGDLTPLSYVAATLSGEREVMFRGERRQAADVHRELGWTPLVLRPKEALALMNGTAVMTGLACLAYARADYLLQLATRITALNVVALQGNPEHFDERLFAAKPHPGQMQVAAWLRKDLAIDAPTAPLHRLQDRYSLRCAPHVLGVLADSLSWLRSFIETELNSANDNPIIDAEAERVLHGGHFYGGHIAFAMDSLKNLVANVADLLDRQLALLVDERYNHGLPSNLSGAPADRAMINHGFKAVQIGTSAWTAEALKNTMPASVFSRSTECHNQDKVSMGTIAARDAIRVLELTEQVAAATLLAANQGVWLRGRDQDARPLPPALAAMHEALGKDFPPVIEDRALEGELRLCLQRIAEQHWRLHA

SEQ ID NO: 157 - DNA, 1545 bp, Unknown
  Obtained from environmental sample
atgacgacgccaacccatgagccggtaaccttcggcgaacgccctttgcgcatcgaagacgtgctggccctggccaaccgtcaggcgcccgtgcagttgcagagcgacgccgattaccgtgagcgcatcgccaagggtgcgcggtttctcgactcgctgctggacaaggaaggcgtgatctatggcgtgaccaccggttacggcgattcctgcgtggttgcggtgccgctgcatcacgtcgaggcgctgccgcgtcatctctacaccttccacggttgcggactgggcaaactgctcgacgcccaggccacccgcgccgtgctggccgcacgtttgcagtcgctgtgccacggcgtttccggggtgcgcattgaactgctggagcgcctgcaagagttcctcgaacacgacatcctgccgctgattcccgaagaaggctcggtgggcgccagcggcgacctgacgccgctgtcctacgtcgccgcgaccctgtccggcgagcgcgaagtgatgttccgtggcgaacgccgacaagcggccgacgtgcatcgcgaactcggctggacgccattggtgctgcgcccgaaagaagcgctggccttgatgaacggcacagcagtgatgactggccttgcctgtcttgcctacgcccgcgccgactacctgctgcaactggccacacgcatcaccgcgctcaacgtggtcgcgctgcaaggcaatccggaacacttcgacgaacgcctgttcgccgccaaaccgcacccggggcaaatgcaggtcgccgcgtggctgcgcaaggatctggcgatcgacgcgccgaccgcgccgctgcatcgcctgcaggatcgctactcgctgcgttgcgccccacacgtgctcggcgtgctggccgacagcctgagctggctgcgttcgttcatcgaaaccgaactcaacagcgccaacgacaacccgatcatcgacgccgaagccgagcgcgtgctgcacggcgggcacttctacggcgggcacatcgcgttcgccatggacagcctgaaaaacctcgtggccaacgtggccgacctgctcgaccgacaactcgcgctgctggtcgacgagcgctacaaccatggtttgccgagcaacctgtccggcgccccggcggatcgcgccatgatcaaccacggcttcaaggccgtgcagatcggcaccagcgcctggaccgccgaagccctgaaaaacaccatgccggccagcgtgttctcacgctccaccgagtgccacaaccaggacaaggtgagcatgggcaccatcgccgcccgcgacgcgatccgcgtgctggagctgaccgaacaggtcgccgctgccacgttgctcgcggctaaccaaggtgtgtggctgcgcggtcgcgatcaggatgcgcgaccgctgccgcccgctctggccgccatgcacgaagcactgggcaaagacttcccgccggtcatcgaagaccgtgcgctggaaggcgaactgcgcctgtgcctgcaacgcatcgccgagcaacactggaggctgcatgcgtag

SEQ ID NO: 158 - protein, 514 aa, Unknown; identical to SEQ ID NO: 156
  Obtained from environmental sample
  DOMAIN (8)...(486): Phenylalanine and histidine ammonia-lyase

SEQ ID NO: 159 - DNA, 1542 bp, Unknown
  Obtained from environmental sample
atgtcatcaaccgccgacagcacagtgcatttaggccaacgctatcttagtcttgagcaagtggtggctatagccaaaggcgctgcggtcaaactgacagatactgctgactatgttgaatatattcaaaaaggtgcacgctttattgacagcgtactccatgaagaaggcgtggtttatggcgtgacaacgggttacggcgactcgtgtacagttaatgttagcttagatttagtccacgaattaccgctgcacttaacccgcttccatggctgtggcttaggcgatgtatttagcccgatgcaagcccgcgcgattatggcttgccgcttaaactcactggctgtgggcaaatcaggtgtaagttatttactgctacaacgcatcgagtggctcttaaacaatgatattactccggtgatcccccaagagggctcggtcggcgccagtggcgatttaaccccattatcttatcttgctgcggtattagttggcgaacgtgaagtgatttaccaaggtaaacgccaagcgactaaagatgtttatctacaatttggcatgatgccattaaccttgcgccctaaagaaggtctcgcattaatgaatggtactgcggttatgacggcacttgcttgtttagcctatgacagatcgcaatatttaacccgcctatcaagccggataaccgccatggcatcgttaacgctcaaaggtaacgcaaaccattttgatgaaattttatttgccgccaagcctcacccaggtcaaaaccagattgccagttggatccgtgaggacttaaatcatcatgtgcatccccgaaattcagaccgcctacaagaccgttattctatccgctgtgcaccgcacatcatcggcgtattgcaagatgctctaccctttatgcgtcagtttattgaaaccgaacttaacagcgctaacgataatccgattgttgatgccgaaggtgaacatattctccatggtggccatttttatggtggccatattgcctttgccatggatgcgatgaaaaatgccgtagccaatatcgccgacttaatcgatcgccaaatggccttagtgatggaccctaaatttaacaatggcttaccggctaatttatccgctgcagaaggtgagcgccgtgcaattaatcacggttttaaagccgtgcaaattggcgtatcagcatggactgctgaagcattaaaaaacactatgccagccagcgtgttttcacgttcaacagaatgtcacaaccaagacaaagtgagcatgggcaccatagctgcacgtgattgtatgcgtattttacagctcacagaacaagtcgctgccgcggcattgttagccatgagccaaggtattcaactgcgtattatgcagcaggaactcgatgcgagttcattaaccccctctcttgcaacgaccttagcccaagtcagcgaagattttgaactgctaaccgaagaccgtcctttagagacggtattgcgccaaacagtggaaaagattcaattgggtctgtgggaggtgtgc

SEQ ID NO: 160 - protein, 514 aa, Unknown
  Obtained from environmental sample
  DOMAIN (8)...(484): Phenylalanine and histidine ammonia-lyase
MSSTADSTVHLGQRYLSLEQVVAIAKGAAVKLTDTADYVEYIQKGARFIDSVLHEEGVVYGVTTGYGDSCTVNVSLDLVHELPLHLTRFHGCGLGDVFSPMQARAIMACRLNSLAVGKSGVSYLLLQRIEWLLNNDITPVIPQEGSVGASGDLTPLSYLAAVLVGEREVIYQGKRQATKDVYLQFGMMPLTLRPKEGLALMNGTAVMTALACLAYDRSQYLTRLSSRITAMASLTLKGNANHFDEILFAAKPHPGQNQIASWIREDLNHHVHPRNSDRLQDRYSIRCAPHIIGVLQDALPFMRQFIETELNSANDNPIVDAEGEHILHGGHFYGGHIAFAMDAMKNAVANIADLIDRQMALVMDPKFNNGLPANLSAAEGERRAINHGFKAVQIGVSAWTAEALKNTMPASVFSRSTECHNQDKVSMGTIAARDCMRILQLTEQVAAAALLAMSQGIQLRIMQQELDASSLTPSLATTLAQVSEDFELLTEDRPLETVLRQTVEKIQLGLWEVC

SEQ ID NO: 161 - DNA, 1560 bp, Shewanella pealeana ATCC 700345
atgacccaagataatacctataaccttagccagcaaaccgttgaatttggctataacagcctatcgcttgaagatgtggtggctatcgccaaaggcgcaacagccaagctgaatcaaacgaccgaataccgcagctatattcaaaaaggcgcgctgtttatcgatagcctgcttaaagaagagggcgtggtttacggcgtcactacaggttatggtgattcttgtactgtcactgtgggtcttgacttggttcatgagctaccgctgcacctgactcgttttcatggctgtggtatgggtgagatcctgtcgccgatgcaagctcgcgccgtgatggcatgccgacttagctcgctagctgtcggtaaatctggggtcactttcgagctacttgagcgtatcgaaaccctgcttaatcttaatattactccggtgatccccgaagagggctcagttggcgccagtggcgacttaacgccactatcttatctagcagcggtattgatcggcgagcgcgatgtgatttaccaaggtgaacgacgcccaactagccaagtgtaccaagagcttaatatcgtaccgctaaaacttcgtccgaaagaaggcctagcgctaatgaacggcactgcggtcatgacggcgctagcttgtttagcctatgacagagcccagtacatggcgcgtcttgccagccgtatcaccgccatggcatcactgacccttaaaggtaactcgaatcacttcgacgacatcttatttgccgctaagccgcacccgggccagaaccaaatcgctgcttggatccgtgaagacttgaatcatcatattcatccacgtaactccgacagactgcaagacagatactctatccgctgtgcaccccatgtgattggtgtgctacaagacgcgctgccgtttatgcgtcagtttattgaaactgaactcaacagcgccaacgacaacccaattgttgatggtgaaggcgagcatattctacatggcggtcacttctatggcggccacatcgcctttgccatggatgcgatgaaaaatgcggtagccaatattgccgatcttatcgatcgccagatggcattagtcatggatcagaaattcaataacggtttaccggccaacttatcgggcgctcaaggcagacgtaaggcgattaaccacggctttaaagcggtgcagattggcgtatccgcgtggacggctgaagccctgaaaaacaccatgccagccagcgtgttctcacgctctaccgagtgccataaccaagataaggtcagcatgggcaccatctcggctcgtgattgtatgcgcgtattacaactgaccgagcaagtcgctgcggcggcgttactggccatgtcgcaaggtattcgcctgcgcattgctcaagaggagctcgtcgaaagctcgattacaccttctttagccaatacccttgctcaagttgaagccgactttgaattattaactgaagatagaccgctagagcagaccctacgctctaccgtcgataagatccaaaatggctactgggaagtgtgcggt

SEQ ID NO: 162 - protein, 520 aa, Shewanella pealeana ATCC 700345
  DOMAIN (13)...(493): Phenylalanine and histidine ammonia-lyase
MTQDNTYNLSQQTVEFGYNSLSLEDVVAIAKGATAKLNQTTEYRSYIQKGALFIDSLLKEEGVVYGVTTGYGDSCTVTVGLDLVHELPLHLTRFHGCGMGEILSPMQARAVMACRLSSLAVGKSGVTFELLERIETLLNLNITPVIPEEGSVGASGDLTPLSYLAAVLIGERDVIYQGERRPTSQVYQELNIVPLKLRPKEGLALMNGTAVMTALACLAYDRAQYMARLASRITAMASLTLKGNSNHFDDILFAAKPHPGQNQIAAWIREDLNHHIHPRNSDRLQDRYSIRCAPHVIGVLQDALPFMRQFIETELNSANDNPIVDGEGEHILHGGHFYGGHIAFAMDAMKNAVANIADLIDRQMALVMDQKFNNGLPANLSGAQGRRKAINHGFKAVQIGVSAWTAEALKNTMPASVFSRSTECHNQDKVSMGTISARDCMRVLQLTEQVAAAALLAMSQGIRLRIAQEELVESSITPSLANTLAQVEADFELLTEDRPLEQTLRSTVDKIQNGYWEVCG

SEQ ID NO: 163 - DNA, 1572 bp, Unknown
  Obtained from environmental sample
atgaacaatccagtcaataaatacgttgtttttggcaatcagccgctacagattgaagatattttggcccttaccgagcaacgtgccagcgcgcgtttgcaggatgatcctgagtttcgtcagcacatcgcgcgcggtgcggcgtttttagattctttattagaccgtgaaggcgttatttatggtgtgactactggttacggcgattcttgcgtggtgccggtgccgttgcatcaggttgaagccctgcctaagcatctgtacaccttccatggttgtggccttggtcagcatctcgatgcggcgggcactcgtgcggtattggcagcgcgtttgcagtcattgtgttttggtatgtcgggcgtgcgtgttgaattgctagagcgtctacaggcttttctggaacatgacactttgccgttgattcctgaagaaggttcagtcggtgccagcggtgacttaaccccactgtcttatgtggcggccactttatccggtgagcgccaagtgctgtatcaaggcaaggtttgcgactcagctgaagtgcatcaaactttgggttggcagccgttagtattgcgcccgaaagaagccttggccttgatgaatggcacagcggtaatgaccggtatcgcttgccaagcgtatggccgcgctgaatatctcttgaaattggccacacgtatcacctcgatgaatatggtggcgttgcagggtaatactcagcattttgatgagcgtttgttcttagccaaaccgcacccagggcagatgcaagttgccgcttggttacgagaagatttagacagcgcccgtgagagcaatcaaggccatgccgctgatgcagagttacgtggcttgcaccgcctgcaagatcgttactccttacgctgtgcgccgcatgtcttaggcgttttggcggacagcttggcgtggttacgtcgttttattgaaaccgaactcaatagcgccaatgacaatccaatcattgatgccgaagaagaacgtgtgctgcatggcggacatttctatggtgggcatattgcctttgccatggatagtttgaaaaatctgattggtaatattgcggatttgctcgatcgccagctggcactgctggtggattgccgttacaaccacggtttaccaagtaatttgtctggcgcaccagcagcgactgcgatgattaaccatggctttaaagcggtgcaaattggtgccagtgcttggactgccgaagctttgaaaaacaccatgccggccagtgtcttctcgcgctctaccgaatgccacaaccaagataaagtcagcatgggtaccattgctgctcgtgatgcacgacgtagcttggagctggttgagcaagtcgcagcggccactttattggcggcgcaacaaggggtttggttgcgtgggcaaatggccgagcaaaaactgcctgctgcgttagcggttatgcatgctgagctggcgaaagattttccaccgttaatcgaagaccgtgcactggaagctgagttacgtttgtgcttgcagcggattcgcgcacagcattggagtctttatgcgtaa

SEQ ID NO: 164 - protein, 523 aa, Unknown
  Obtained from environmental sample
  DOMAIN (8)...(495): Phenylalanine and histidine ammonia-lyase
MNNPVNKYVVFGNQPLQIEDILALTEQRASARLQDDPEFRQHIARGAAFLDSLLDREGVIYGVTTGYGDSCVVPVPLHQVEALPKHLYTFHGCGLGQHLDAAGTRAVLAARLQSLCFGMSGVRVELLERLQAFLEHDTLPLIPEEGSVGASGDLTPLSYVAATLSGERQVLYQGKVCDSAEVHQTLGWQPLVLRPKEALALMNGTAVMTGIACQAYGRAEYLLKLATRITSMNMVALQGNTQHFDERLFLAKPHPGQMQVAAWLREDLDSARESNQGHAADAELRGLHRLQDRYSLRCAPHVLGVLADSLAWLRRFIETELNSANDNPIIDAEEERVLHGGHFYGGHIAFAMDSLKNLIGNIADLLDRQLALLVDCRYNHGLPSNLSGAPAATAMINHGFKAVQIGASAWTAEALKNTMPASVFSRSTECHNQDKVSMGTIAARDARRSLELVEQVAAATLLAAQQGVWLRGQMAEQKLPAALAVMHAELAKDFPPLIEDRALEAELRLCLQRIRAQHWSLYA

SEQ ID NO: 165 - DNA, 1557 bp, Unknown
  Obtained from environmental sample
gtggagagccctgcgttcaagaacatgacccggacagtacgattcgatagggagtgggtgaagatccaagatatcgttgatattgccgacggagtagcctggcccgtactatctgagacgccacagttccgctccgcgattgcacaaggcgcggagtttgtcgatcgactcctgcgtgaagacggcaggatctacggggtgacgacgggttttggcgattcgtgcatggtgacggttggaacggaactcgccgccgagttgccgcgccatctttatacgtatcacggttgtgggctcggggagtatctcacgccggcacagactcgggcagtcatcgcaacccgcttgacttccttatgcaaagggttctccggggtcagtgtcgaactgttggagcaaatggtgcgcttgctgcactgcggtgtgttaccgagaattccatccgaaggctcggtgggcgccagcggtgatcttacgccgctctcttatctcgccgcggtgctctgcggcgagggcgaagcgtggcgcgacggcgccgcggcacccgcggcagtggctttggctcgtgcccgcatcgcgccattaagcctgcggcccaaggaagctctcgcgatcatgaatggcaccgcagtcatgacggctttggcatgtctcgcttattcgcgcgccgagtatctaagccggctggtgactcgggtgacggcgctggcctcgtttgctttagacggcaatgcctatcacttcgacgagacgctattctcagtcaaacctcatccgggacagcagcgggtagctgcttggctgcgcgccgatttgctctgtgatcgaccgccgcgcaacgccacacgccttcaagaccgttattcgattcgctgcgcgcctcacgtcatcggcgtgctcgccgatgccttaccatggctgtgccagtctatcgagaacgagctgaacagcgccaatgacaatccggttatcgatgcggccggtgaacgggttttatacggcggtcacttttatggcggccacatcgccttcgcgatggatagcatgaaaaacgccgtggctaatttggccgatcttctggaccggcaaatggcgctcctggtggacagccgcttcaacaatggcttgccagccaatctgtccggcatcgagggcccgcggctggcgattaatcatgggctcaaagccctgcagatcagcgcttcggcatggacggcggaagtgctaaagctcaccatgccggcttcggtcttttcgcgttccactgaatgccacaatcaagacaaggtcagcatggggacaattgcagcgcgcgattgcctgcgcattttggaattgaccgagcaagttgtcgccgcgctgttgatcaccgtccggcaaggggtttggcttcgctgcagatcgaatggctctttgagattgcaagcggcgttacagacgatgatgcatcagttggagaacgatgtcgtcgcccttgaggaagaccgacggcttgaaccggacctgcgattacttctggaacgcatccgcagccgcgcgtggaaactctatgagtaa

SEQ ID NO: 166 - protein, 518 aa, Unknown
  Obtained from environmental sample
  DOMAIN (12)...(495): Phenylalanine and histidine ammonia-lyase
MESPAFKNMTRTVRFDREWVKIQDIVDIADGVAWPVLSETPQFRSAIAQGAEFVDRLLREDGRIYGVTTGFGDSCMVTVGTELAAELPRHLYTYHGCGLGEYLTPAQTRAVIATRLTSLCKGFSGVSVELLEQMVRLLHCGVLPRIPSEGSVGASGDLTPLSYLAAVLCGEGEAWRDGAAAPAAVALARARIAPLSLRPKEALAIMNGTAVMTALACLAYSRAEYLSRLVTRVTALASFALDGNAYHFDETLFSVKPHPGQQRVAAWLRADLLCDRPPRNATRLQDRYSIRCAPHVIGVLADALPWLCQSIENELNSANDNPVIDAAGERVLYGGHFYGGHIAFAMDSMKNAVANLADLLDRQMALLVDSRFNNGLPANLSGIEGPRLAINHGLKALQISASAWTAEVLKLTMPASVFSRSTECHNQDKVSMGTIAARDCLRILELTEQVVAALLITVRQGVWLRCRSNGSLRLQAALQTMMHQLENDVVALEEDRRLEPDLRLLLERIRSRAWKLYE

SEQ ID NO: 167 - DNA, 1557 bp, Unknown
  Obtained from environmental sample
atggatcgcgctaaccggaccggcagcactcgggaagtgaccttcggcgccgaaagcatccggatcggcgacgtagttgatatagccaaggggtccgtgcgggcccgcctatctcaagacggcgcgtttcgctcgaagatcgccgcgggagcggacctggtcgatcgcctgcttcgccgggaagagatcatttacggcgttaacaccggatttggcgactcctgcaccatcacgattcggccggatttgatcagcgagctgccgcgccatctgtacacgtatcatggctgcggcctcgggacctatctgagcccgccacaaacccgcgccgtcattgcgacgcggctcgcatccctgtgtaagggattttcgggcgtcggcgtggaactgctcgagcagctcgtcgcattcctcaattacgacttgctgccggcaattccgtctgaaggctccgtcggagccagcggcgacctcacgccgctctcctatgtagccgcggccttgtgcggcgaaggcgagatctggcgcgacggcttgcgcgtttccgcagagcaggcgctgcgaagggctggaataaagcctcttcggctgcgaccgaaggagggcctcgcgctgatgaacggcacgtcggtcatgacggctctcgcctgcctcgcctgtgcacgagcggattacctcatgcaactcgccacgaaagtgactgccctcgcatcgttggggctcggcggcaatgcctaccacttcgatgaaaccctgttttcggtaaaaccgcactccggccaacagcaaatcgcgtcatggctgcgcggtgatcttggatcggattccgcccagcttgatggcgcccggctccaggaccgctattcgatccgatgcgcgcctcacgtgatcggtgttctcgccgatgcgatgcctttcttgcatcgctttgtcgaaaacgaggtcaacagcgccaacgacaacccgctcattgacgtcgaagcggagcgagttctgtacggcggacatttctatggcggccacatcgcgttcgccatggacagcatgaaaaacgcggtcgccaatatcgccgaccttctcgatcgccagatggcgcaactggtggacagtcgctacaataatgggctgacaccgaatctttccggcgtccagggccaacgcgccgcgatcaatcacggtctcaaggcgctccagatcagcgtttcggcatggacagcggaagcactcaagctcacgatgccggcatccgtgttctcccggtcgacggaatgtcacaatcaggacaaggtcagccttggcaccctcgccgctcgcgacgccttgcgcgtcatcgaactcacagaacaggtgatcgcggccatgctcattaccgttcggcaggccgcgtggctgcgcgcacgagtgaaccccgccgtggcgccgcggccgccgcttcagaagatacttaccgagttaagcaccgatatcgctgcgatcgaggaagacaggcggctggactccgaactacgactgctgctcacccggatcgagcatcgcgcctggaacctttatgattaa

SEQ ID NO: 168 - protein, 518 aa, Unknown
  Obtained from environmental sample
  DOMAIN (12)...(487): Phenylalanine and histidine ammonia-lyase
MDRANRTGSTREVTFGAESIRIGDVVDIAKGSVRARLSQDGAFRSKIAAGADLVDRLLRREEIIYGVNTGFGDSCTITIRPDLISELPRHLYTYHGCGLGTYLSPPQTRAVIATRLASLCKGFSGVGVELLEQLVAFLNYDLLPAIPSEGSVGASGDLTPLSYVAAALCGEGEIWRDGLRVSAEQALRRAGIKPLRLRPKEGLALMNGTSVMTALACLACARADYLMQLATKVTALASLGLGGNAYHFDETLFSVKPHSGQQQIASWLRGDLGSDSAQLDGARLQDRYSIRCAPHVIGVLADAMPFLHRFVENEVNSANDNPLIDVEAERVLYGGHFYGGHIAFAMDSMKNAVANIADLLDRQMAQLVDSRYNNGLTPNLSGVQGQRAAINHGLKALQISVSAWTAEALKLTMPASVFSRSTECHNQDKVSLGTLAARDALRVIELTEQVIAAMLITVRQAAWLRARVNPAVAPRPPLQKILTELSTDIAAIEEDRRLDSELRLLLTRIEHRAWNLYD

SEQ ID NO: 169 - DNA, 1548 bp, Unknown
  Obtained from environmental sample
atgacgaatcaaattcctgagccggtcattttcggcgaacgcgccctgcgcatcgaagacgtacgagcactcgccgatcgccaggtcgccaccgggcttcagcgcgatgatgcctggcgcgagcgcatcgccaagggcgcccggttcctcgattcgttgctggacaaggaaggcgtgatctatggcgtcaccacgggctacggtgactcgtgcgtggtggcggttccgatgcagcacgtcgaggccctgccgcgtcatctgtacacgttccacggatgtggtctgggcaaactgcccgatgcccaggccacgcgtgcggtgctggccgcgcgcctgcagtcgctgtgccacggcgtgtcaggcgtacgcgtcgaacttctggagcgcttgcaggcgttcatcgcccacgacgtactgccgctgatcccggaagaaggctcggtgggcgcgagcggcgacctgacacccttgtcgtacgtggccgcgaccctgtccggtgagcgcgaagtgatgttccgcggcgagcggcgctcggccgccgacgtgcaccgcgagctgggctggacgccgctggtactgcggcccaaggaagccctggcgctgatgaatggcaccgccgtcatgacggggctggcctgcctggcgttttcccgcgccgattacctgctgaaactggcgacgcgcatcacggccctcaacgtcgtggcgcttcaaggcaatccggaacacttcgatgaacgtctgttcgccgccaagcctcatccggggcagatgcaggtggccgcctggctgcgcgaggatctggccatcgacgccccgaccgcgccgctgcaccggctgcaggaccgctattcgttgcgctgcgcgccgcatgtgctgggcgtgctggcagacagcctcggctggctgcgctcattcatcgagacagagctcaacagcgccaacgacaaccccattatcgatgccgaagcggaacgcgtgctgcacggcgggcatttctatggcgggcatatcgcgttcgccatggacagcctgagaaatctggtggccaacgtcgccgacttgctcgatcggcagctggctctgctggtggacgagcgctacaaccacggtctgccgagcaatctttccggagccagcgccgagcgggcgatgctcaaccatggtttcaaggccgtacagatcggcgccagcgcatggactgccgaagccttgaagaacaccctgcccgccagcgtgttttcccggtcgaccgagtgccataaccaggacaaggtcagcatgggcaccatcgccgcgcgggacgccatccgggtgctggagctgaccgagcaggtagccgctgccaccctgatcgcggccaatcagggcgtctggctgcggagccgcgcgcccgatgcccgaccgttgccgcccgcgctggcgacgatgcatgagcaactcagcgaggacttcgcgccggtcatcgaggaccgggcgcttgagggtgagctgcgcctgtgcctgagccacatcgccaaccgccgttggaggctgcatgcgcagtaa

SEQ ID NO: 170 - protein, 515 aa, Unknown
  Obtained from environmental sample
  DOMAIN (7)...(486): Phenylalanine and histidine ammonia-lyase
MTNQIPEPVIFGERALRIEDVRALADRQVATGLQRDDAWRERIAKGARFLDSLLDKEGVIYGVTTGYGDSCVVAVPMQHVEALPRHLYTFHGCGLGKLPDAQATRAVLAARLQSLCHGVSGVRVELLERLQAFIAHDVLPLIPEEGSVGASGDLTPLSYVAATLSGEREVMFRGERRSAADVHRELGWTPLVLRPKEALALMNGTAVMTGLACLAFSRADYLLKLATRITALNVVALQGNPEHFDERLFAAKPHPGQMQVAAWLREDLAIDAPTAPLHRLQDRYSLRCAPHVLGVLADSLGWLRSFIETELNSANDNPIIDAEAERVLHGGHFYGGHIAFAMDSLRNLVANVADLLDRQLALLVDERYNHGLPSNLSGASAERAMLNHGFKAVQIGASAWTAEALKNTLPASVFSRSTECHNQDKVSMGTIAARDAIRVLELTEQVAAATLIAANQGVWLRSRAPDARPLPPALATMHEQLSEDFAPVIEDRALEGELRLCLSHIANRRWRLHAQ

SEQ ID NO: 171 - DNA, 1557 bp, Unknown
  Obtained from environmental sample
atggacagcactgagctcaagaaaaggacccggactatccgattcaacatcgaatgggtgaagatcgaagacatcgttgatgttgccgacggactggcgtggcccgtcttgtcccaagcgccggagttccgctcggcaatagcgcagggcgcggagtttgtcgagcggctcgtgcgcgaagagggcaggatctacggcgttacaacaggttttggcgattcatgcatggtgacggtggcgagtgaattggcggccgagttgccgcgccacctttatacttatcaccgttgcggcctcggggagtatctcacaccggcgcaaacccgcgccgtgatcgccacccgcctaacctctttatgtaaagggttttccggcgtcagtgtcgaattattggagcagttgatgcggttgctccaagccgggctgttaccgagaattccgtccgaaggttcggtcggcgccagcggtgatcttacgccgctctcttacctagccgccgtactctgcggcgagggcgaagtgtggggcgacggcgcagcggcaccggcggcggcggctttggctgatgccggaatcgtgccgttaagactgcggccgaaagaagctctcgcggtcatgaatggcaccgccgtaatgaccgctttggcatgtctcgcatactcccgtgccgagtatctaagccggttggtgactcgggttacggcgctggcctcgtttgctttggacggcaatgcctatcactttgacgagaccctattctcggtcaaacctcatcggggtcagcagcgggtagccgcttggcttcgtgaggatttgatgtgtgatcaaccgcggcgcaacgacagccgaatccagggccgctactcgattcgctgcgcaccccatgtcattggcgtgctggccgatgccttaccttggctgcgcgaatatatcgagaacgaactgaatagcgccaatgataatccaatcatcgatgcagctggtgaacgcgtcttgtacggcggtcacttctatggcggccacattgcctttgcaatggatagcatgaaaaacgccgtcgctaatttggccgatcttctcgaccggcaaatggcgctcctggtagacagtcgtttcaacaatggtttgccggccaatctgtccggcattgagggaccccgtctagcgattaatcacggtctcaaagcgctgcagatcagcgcatcggcatggacggcggaagcgctcaagctaaccatgccggcttcggtcttttcccgttctactgagtgtcataaccaagacaaggtcagcatggggacgattgcagcgcgcgattgcctgcgcgttctggaattgaccgagcaagttgtcgcggcgctcctgatctcagtgcgccagggggtctggcttagacgcagattaaatccctcttcgatcccgcaagcggcgccacagcgaatgctgcacgatctggagaacgacatcgccgccatcgaggaagaccgaccgctcgagccggacttgcgattacttatggaacgcatccacagtcgtgcgtggaaattatatgagtaa

SEQ ID NO: 172 - protein, 518 aa, Unknown
  Obtained from environmental sample
  DOMAIN (12)...(490): Phenylalanine and histidine ammonia-lyase
MDSTELKKRTRTIRFNIEWVKIEDIVDVADGLAWPVLSQAPEFRSAIAQGAEFVERLVREEGRIYGVTTGFGDSCMVTVASELAAELPRHLYTYHRCGLGEYLTPAQTRAVIATRLTSLCKGFSGVSVELLEQLMRLLQAGLLPRIPSEGSVGASGDLTPLSYLAAVLCGEGEVWGDGAAAPAAAALADAGIVPLRLRPKEALAVMNGTAVMTALACLAYSRAEYLSRLVTRVTALASFALDGNAYHFDETLFSVKPHRGQQRVAAWLREDLMCDQPRRNDSRIQGRYSIRCAPHVIGVLADALPWLREYIENELNSANDNPIIDAAGERVLYGGHFYGGHIAFAMDSMKNAVANLADLLDRQMALLVDSRFNNGLPANLSGIEGPRLAINHGLKALQISASAWTAEALKLTMPASVFSRSTECHNQDKVSMGTIAARDCLRVLELTEQVVAALLISVRQGVWLRRRLNPSSIPQAAPQRMLHDLENDIAAIEEDRPLEPDLRLLMERIHSRAWKLYE

SEQ ID NO: 173 - DNA, 1566 bp, Unknown
  Obtained from environmental sample
atgcatcttgctgatattaaaactacccaacgcgaagtcagattcgaccagagtcgcctgacgatagaagacgtggccgatatcgccaaaggcaaagccaaggcgattttgtcggacgatccgcaatttcgcgcagccatcgcgcgcggtgcggatttcctggatcgtctgctgcgtgaagacggcatcatttatggcgtgacgaccggttacggtgactcatgcacggtggttgtaccgccggaactgattcctgatttgccgcaccacttgtttacgtatcacggttgcggcctgggtgaatacctgacgccggcgcaaacgcgtgccgtcatggcggcacgactggcttccctgagcaaaggatattccggtgtctcggtcgaattgctgcagcagatagcgcgcctgctggatgcaggcttgttgccgctgattccatctgaaggttcggttggtgccagcggcgacttgacgcctttgtcttacttggcggcagtgctgtgcggtgaacgtgaagtctggcgcgacggcgtacaagtgccggcagaacaggctctgcgcgaagcgggtattcagcctttgcgtctgcgcccgaaagaaggacttgccatcatgaatggcacggcggtcatgaccgcgctggcatgtctggcatacgaccgcgcggcttatctgactaaactgactacgcgtattacggcgatggcatcgtttgcgctggatggcaatgcccatcacttcgatgaaaccctgttctccgtcaagccgcatccgggtatgcaacaagtcgcggcctgtttgcgccaggatctgcagtgcgagcaattggaacgtaacggcaagcgcttgcaggacagatattcaatacgttgcgcgccacacgtcatcggcgtgctggcagatgccttgccattcttccgccagtctatcgagaacgagctcaatagcgccaacgataatccgatcatcgacgccgaaggtgaacgtgtcttgcatggcggtcatttctacggcggccacatcgcctttgcgatggacggcatgaagaatgcggtggctaatctggcggatttactggatcgtcaaatggcattgctggttgacagccgttacaaccatggattgccagctaatctgtcgggtgcagaaggtgcgcgcgcacctatcaatcacggtttgaaggctttgcagatcagtgcatcggcgtggaccgcagaagcactcaagctgactatgcctgcttccgtcttctcgcgttcgactgaatgccataaccaggacaaagtcagcatgggtacgatcgctgcgcgtgattgcttgcgcgtgctggaattgaccgagcaggttgtcgctgccttgctgattaccgtacgtcagggtgtgtggctgcgttgccgcatgaatccggcggtgcagccggatgcgccgttgcagcaaatgctggacatgctggctgacgatgtggcggtggtcgaagaggaccgtcgtctggaaccggatttgcgcttgctgctggaacgtatccgtagccagtcatgggagttgtatgcgtcgcaaagctga

SEQ ID NO: 174 - protein, 521 aa, Unknown
  Obtained from environmental sample
  DOMAIN (12)...(490): Phenylalanine and histidine ammonia-lyase
MHLADIKTTQREVRFDQSRLTIEDVADIAKGKAKAILSDDPQFRAAIARGADFLDRLLREDGIIYGVTTGYGDSCTVVVPPELIPDLPHHLFTYHGCGLGEYLTPAQTRAVMAARLASLSKGYSGVSVELLQQIARLLDAGLLPLIPSEGSVGASGDLTPLSYLAAVLCGEREVWRDGVQVPAEQALREAGIQPLRLRPKEGLAIMNGTAVMTALACLAYDRAAYLTKLTTRITAMASFALDGNAHHFDETLFSVKPHPGMQQVAACLRQDLQCEQLERNGKRLQDRYSIRCAPHVIGVLADALPFFRQSIENELNSANDNPIIDAEGERVLHGGHFYGGHIAFAMDGMKNAVANLADLLDRQMALLVDSRYNHGLPANLSGAEGARAPINHGLKALQISASAWTAEALKLTMPASVFSRSTECHNQDKVSMGTIAARDCLRVLELTEQVVAALLITVRQGVWLRCRMNPAVQPDAPLQQMLDMLADDVAVVEEDRRLEPDLRLLLERIRSQSWELYASQS

SEQ ID NO: 175 - DNA, 1560 bp, Unknown
  Obtained from environmental sample
atgacgacgacttctgctcccactccaacccgtcgcatctgttttggcaacgatcccctcaccgtggatgacgtggtcgccatcgcacaccggcaagcaaccgtggcgctatccgatgccccggactttcgcatgcgcatcgatgcgggagcacagttcctcgaccggctgcttgacgaagatggtgtggtctacggcgtcaccaccggctatggcgactcctgcaccacggcggttccgctcgacctggtgccggaactgccccaccatctggtcgcgtaccacgggtgcggcacagggcggatactgactgaggaagaaacccgcgccgtgctggctgcgcgactgacctcgctatcgctcggcctgtccggcatcagttatgccttgctccggcagctcaccgacctgctggagcacgatatcctgccctgcattccggcggaaggctccgtaggcgcgagcggcgacctgacgccgctgtcctatgtcgctgctgtcctgtgcggcgagcgcgacgtacgctatcgcggtaccgtgcgcccgacgcgcgaggtgttcgacgaatgcggtatcgcaccgctgcgactgcgccccaaggaaggtttggctatcatgaacggcaccgctgtcatgaccggcctcgcctgccttgcatgggaccgcgcacaatcgctagcgcacatggcaacgctcatcaccgcctgcaacgtgcatatcgccgccggcaacgcccaccactttgatgccggactgttcgacgccaaaccacatccgggccagcagcgcgctgccaaacgcatccgccgcgtgctcgactcgccgcagcccgcacgcaatgaagcccgcctgcaggaccgctattcgctgcgctgtgcaccgcatgtgatcggtgttctggaagacgcatcggactgggcacgccaatggatcgaaaacgagctggacagcgccaacgacaacccgctgatcgatccggaacgtgaatgcgtgttgcatggcggacatttctacggtggccatatcgcctttgcgatggacggactcaaaaccgctgtcgccaatatcgccgacctgctcgaccgccagctcgcgctgctggtggatacgcgctacaaccatggtttgccggccaatctctccggcgccaccggtccgcgcgctgccatcaaccatggcctcaaagcactgcagatcagcgtgtccgcatggacagccgaagcgctgaagctgacgatgccggcgtccgtgttctcgcgctccaccgaatgccacaatcaggacaaggtcagcatgggcacgatcgccgcgcgcgactgcctgcgcatcgtcacgctgacggaacaggtcatggcggccatgctgattgcggtacgccagggcgttccgctacgtacgcgcgtggacccggatggcgtcgtgccgcagcgaatcgcagcgtttcacgaagcgctggccgaggtcatcccgttccttgacgaggaccgagcgctcgaccagaccttgcatctgctgctgagtgaattgcatgcccagcgctggagccatcatgccagctga

SEQ ID NO: 176 - protein, 519 aa, Unknown
  Obtained from environmental sample
  DOMAIN (12)...(493): Phenylalanine and histidine ammonia-lyase
MTTTSAPTPTRRICFGNDPLTVDDVVAIAHRQATVALSDAPDFRMRIDAGAQFLDRLLDEDGVVYGVTTGYGDSCTTAVPLDLVPELPHHLVAYHGCGTGRILTEEETRAVLAARLTSLSLGLSGISYALLRQLTDLLEHDILPCIPAEGSVGASGDLTPLSYVAAVLCGERDVRYRGTVRPTREVFDECGIAPLRLRPKEGLAIMNGTAVMTGLACLAWDRAQSLAHMATLITACNVHIAAGNAHHFDAGLFDAKPHPGQQRAAKRIRRVLDSPQPARNEARLQDRYSLRCAPHVIGVLEDASDWARQWIENELDSANDNPLIDPERECVLHGGHFYGGHIAFAMDGLKTAVANIADLLDRQLALLVDTRYNHGLPANLSGATGPRAAINHGLKALQISVSAWTAEALKLTMPASVFSRSTECHNQDKVSMGTIAARDCLRIVTLTEQVMAAMLIAVRQGVPLRTRVDPDGVVPQRIAAFHEALAEVIPFLDEDRALDQTLHLLLSELHAQRWSHHAS

SEQ ID NO: 177 - DNA, 1545 bp, Unknown
  Obtained from environmental sample
atgacgacgccaacccatgagccggtaaccttcggcgaacgccctttgcgcatcgaagacgtgctggccctggccaaccgtcaggcgcccgtgcagttgcagagcgacgccgactatcgcgagcgcatcgccaagggcgcgcggttcctcgattcgctgctggacaaggaaggcgtgatctacggcgtgaccaccggttatggcgattcctgcgtggttgcggtgccgctgcatcacgtggaggcgctgccgcgtcacctttacgccttccatggttgcgggctgggcaaattgctcgacgcgcaggccacccgcgcggtgctggcggcgcgtttgcagtcgctgtgtcacggtgtgtccggggtgcgcgtggaactgcttgagcgtctgcatgccttcctcgaatacgacatcctgccgctgattcccgaagaaggttcggtcggcgccagcggcgatctgacgccgttgtcctatgtcgccgcaaccctgtccggcgagcgcgaagtgatgttccgtggcgaacgtcgccaggccgccgatgtgcatcgcgaactcggctggacgccgctggtgttgcgtccgaaagaagccttggccctgatgaacggcaccgccgtgatgaccggtctcgcctgcctcgccttcgcccgcgccgattatctgctgcaactggccacgcgcatcactgcgctcaatgtggtcgcactgcaaggcaacccggaacacttcgacgaacgcctgttcgctgccaaaccgcatccggggcaaatgcaggtcgccgcgtggttgcgcaaggatctggcgatcgacgcccccaccgcgccgctgcatcgcctgcaggatcgttactcgctgcgctgtgcaccgcatgtcctcggcgtgttggccgacagcctgaactggctgcgctcgttcatcgaaaccgaactgaacagcgccaacgacaacccgatcatcgacgccgaagccgaacgcgtgttgcacggtggacacttctacggcgggcatatcgcgttcgccatggacagcctgaaaaacctggtggccaacgttgctgacctgctggatcggcaactcgcgctgctggtcgacgaacgctacaaccacggcctgccgagcaacctctccggtgctccggcggaccgggcaatgatcaaccatggcttcaaagccgtgcagatcggcaccagcgcgtggaccgccgaagcattgaaaaacaccatgccggccagcgtgttctcgcgctccaccgagtgccacaatcaggacaaagtcagcatgggcaccatcgccgcccgcgatgcaattcgcgtgctggagctgaccgaacaagtcgccgccgccacattgctcgccgccaaccagggcgtatggctgcgcgcacaggccgaagacgcccgaccgctgccaccctcgctggcggcaatgcacgcagaactggccaaggacttcccgccggtcatcgaggaccgcgcgctggaaggcgaattgcgcctgtgcctgcaacgtatcgccgcacaacactggaggctgcatgcgtag

SEQ ID NO: 178 - protein, 514 aa, Unknown
  Obtained from environmental sample
  DOMAIN (8)...(486): Phenylalanine and histidine ammonia-lyase
MTTPTHEPVTFGERPLRIEDVLALANRQAPVQLQSDADYRERIAKGARFLDSLLDKEGVIYGVTTGYGDSCVVAVPLHHVEALPRHLYAFHGCGLGKLLDAQATRAVLAARLQSLCHGVSGVRVELLERLHAFLEYDILPLIPEEGSVGASGDLTPLSYVAATLSGEREVMFRGERRQAADVHRELGWTPLVLRPKEALALMNGTAVMTGLACLAFARADYLLQLATRITALNVVALQGNPEHFDERLFAAKPHPGQMQVAAWLRKDLAIDAPTAPLHRLQDRYSLRCAPHVLGVLADSLNWLRSFIETELNSANDNPIIDAEAERVLHGGHFYGGHIAFAMDSLKNLVANVADLLDRQLALLVDERYNHGLPSNLSGAPADRAMINHGFKAVQIGTSAWTAEALKNTMPASVFSRSTECHNQDKVSMGTIAARDAIRVLELTEQVAAATLLAANQGVWLRAQAEDARPLPPSLAAMHAELAKDFPPVIEDRALEGELRLCLQRIAAQHWRLHA

SEQ ID NO: 179 - DNA, 1542 bp, Unknown
  Obtained from environmental sample
atgacgacacatcagcctgatcccatcgtgtttggcgaacgccccttgagcatcgagcaggtcgtcgccctggccagccgcagcgcgccggcgcagctgcaaagcgatgccgcctaccgcgaaaaaatcgccaagggcgcacgttttctcgacagcctgctgggcaaggaaggcgtgatctacggcgtcaccaccggctacggcgactcctgcgtggtggccgtgccgctgcatcaggtcgaggcgctgccgcgtcatctgtacaccttccacggctgtggcctgggcaagctgctggatgaagccagcacccgcgccgtgctcgccgcgcgcctgcagtcattgtgccacggcgtttccggcgtgcgcgtagaactgctggagcgcctacaggcgtttctcgaatacgacgtgctgccgctgattcccgaagaaggctcggtgggcgccagcggcgacctgacgccgctgtcctatgtcgccgccacccttagtggtgagcgcgaggtgctattcaacggcgagcgccgcaacgccatcgacgtgcacaacgaactgggctggacgccgctggtgctgcgcccaaaagaagccctggcgctgatgaacggcacggcggtgatgaccgctctagcctgccaggcgttctcccgcgctgactacctgctgaaactggccacacgcatcaccgcgctcaacgtggtggccttggaaggcaacccggagcacttcgacgagcgcctattcgccgccaagccgcatccggggcagatgcaggtcgccgcctggttgcgccaggacctggccatcgacgcgccgaccgcgccactgcaccgtttgcaggatcgctactcgctgcgctgcgcgccgcacgtactgggcgtactggccgacagcctgggcctgctgcgccagttcatcgaaaccgagctgaacagcgccaacgacaacccgctgattgatgccgaagaagagcgcgtgctgcacggcgggcacttctacggcgggcatatcgccttcgccatggacagcctgaaaaacctggtgggcaacgtcgccgacctgctcgatcagcagctcgccctgctggtcgacacccgctacaaccacggcctgccgagcaacctgtccggcgcaccaagcgtcagcgcaatgatcaaccacggcttcaaggccgtgcagatcggcaccagcgcctggaccgcagaagccctgaaaaacaccctgccggccagcgtgttctcgcgctccaccgaatgccacaaccaggacaaggtgagcatgggcaccatcgctgcccgcgatgcgctgcgcagtctggagctgaccgagcaggtcgccgccgccaccctgctggccgccaaccaaggcgtatggctgcgccttcgcgacggcaagaccgatattcccgcgccggtcgccgccatgcgtgagcagttggccgtggacttccacccagtcatcgaagaccgcgccctggaagccgagctacgcctgtgtctggtgcgcatccgcgagcagcactggagtctgtatgcgtag

SEQ ID NO: 180 - protein, 513 aa, Unknown
  Obtained from environmental sample
  DOMAIN (8)...(485): Phenylalanine and histidine ammonia-lyase
MTTHQPDPIVFGERPLSIEQVVALASRSAPAQLQSDAAYREKIAKGARFLDSLLGKEGVIYGVTTGYGDSCVVAVPLHQVEALPRHLYTFHGCGLGKLLDEASTRAVLAARLQSLCHGVSGVRVELLERLQAFLEYDVLPLIPEEGSVGASGDLTPLSYVAATLSGEREVLFNGERRNAIDVHNELGWTPLVLRPKEALALMNGTAVMTALACQAFSRADYLLKLATRITALNVVALEGNPEHFDERLFAAKPHPGQMQVAAWLRQDLAIDAPTAPLHRLQDRYSLRCAPHVLGVLADSLGLLRQFIETELNSANDNPLIDAEEERVLHGGHFYGGHIAFAMDSLKNLVGNVADLLDQQLALLVDTRYNHGLPSNLSGAPSVSAMINHGFKAVQIGTSAWTAEALKNTLPASVFSRSTECHNQDKVSMGTIAARDALRSLELTEQVAAATLLAANQGVWLRLRDGKTDIPAPVAAMREQLAVDFHPVIEDRALEAELRLCLVRIREQHWSLYA

SEQ ID NO: 181 - DNA, 1542 bp, Unknown
  Obtained from environmental sample
atgacgacacaacagcctgatcccgtagtttttggcgaacatgctctgagcatcgaacagatcgttgccctggcccagcgccgtgcgcctgcgcacctgcaaagtgatgcggcctaccgcgaaaaaatcgccaagggcgctcgcttcctcgacagcctgctggaccgtgaaggtgagatttacggcgtcaccaccggctacggcgactcctgcgtagtggccgtgccgctgcatcaggtggaagccctgccccgtcatctgttcaccttccatggctgtggccttggcaagctgctggatgcgtccagcacccgtgccgtactcgccgcccgtttgcagtcgctatgccacggcgtatccggcgtgcgcgtggagctgctggaacggctgcaagccttccttgaacacgacatcctgccgctgatcccggaagaaggctcggtcggcgccagcggcgacctcaccccgctgtcctacgtggcggccaccctcagcggtgagcgcgaagtcatgtacaaaggcgaacgccgcagcgctgccgatgtacacgccgagctgggctggacgccactgaccctgcgcccgaaagaagccctggcgctaatgaacggcacggcggtgatgactgccctggcctgcctggcttactcccgcgccgattacctgctgaaactggccacccgcattaccgccctcaacgtggtggcgctggaaggcaacccggaacactttgacgagcgcctgttcgccgccaagccccatccgggccagacccaggtcgccgcctggctgcgtgaagacctggcgatcaacgccccgaccgcgccactgcaccgcctgcaggaccgttactcgctgcgctgcgccccccacgtacttggcgtgctggcggacagcctgggcctgctgcgccagttcatcgaaaccgaactgaacagcgccaacgacaacccgctgatcgatgccgaagccgaacgcgtactgcacggcggccacttctacggcggccatatcgccttcgccatggacagtctgaagaacctggtgggcaacgtcgccgacctgctcgaccgccagctcgccctgctggtggacgtgcgctacaaccacggcctgccaagcaacctgtctggcgcaccggcggcaaccgcgatgatcaaccacggtttcaaggccgtgcagatcggcgccagcgcctggaccgccgaagcgctgaaaaacaccatgccggccagcgtgttctcacgctccaccgaatgccacaaccaggacaaagtcagcatgggcactatcgcggcccgtgacgccctgcgcagtctggaactgtgcgaacaggtagcctctgccacgctgctggcggccaaccagggtgtatggctgcgccagcgcgacggcaaacatgacattcccgcaccgctgctggccatgcgtgaacaactggccaacgacttcccgccggttatcgaagaccgtgccctggaaggcgaactgcgtctgtgcctgagccgtatccgcgaccagcactggagcctctatgcgtag

SEQ ID NO: 182 - protein, 513 aa, Unknown
  Obtained from environmental sample
  DOMAIN (9)...(485): Phenylalanine and histidine ammonia-lyase
MTTQQPDPVVFGEHALSIEQIVALAQRRAPAHLQSDAAYREKIAKGARFLDSLLDREGEIYGVTTGYGDSCVVAVPLHQVEALPRHLFTFHGCGLGKLLDASSTRAVLAARLQSLCHGVSGVRVELLERLQAFLEHDILPLIPEEGSVGASGDLTPLSYVAATLSGEREVMYKGERRSAADVHAELGWTPLTLRPKEALALMNGTAVMTALACLAYSRADYLLKLATRITALNVVALEGNPEHFDERLFAAKPHPGQTQVAAWLREDLAINAPTAPLHRLQDRYSLRCAPHVLGVLADSLGLLRQFIETELNSANDNPLIDAEAERVLHGGHFYGGHIAFAMDSLKNLVGNVADLLDRQLALLVDVRYNHGLPSNLSGAPAATAMINHGFKAVQIGASAWTAEALKNTMPASVFSRSTECHNQDKVSMGTIAARDALRSLELCEQVASATLLAANQGVWLRQRDGKHDIPAPLLAMREQLANDFPPVIEDRALEGELRLCLSRIRDQHWSLYA

SEQ ID NO: 183 - DNA, 1563 bp, Unknown
  Obtained from environmental sample
atgcatgccgctgagttgaagacatcagccttatctcggacgattgccttcgaccatggatggctgaaaatcgaagacatcgtcgatattgcggaaggttcggcaagggtcgcgttgtccgaggctgctgcatttcacgttggcatcaagcgaggagcagacttcctggagcatctgctccgccaagagggcacgatctatggcgttactacgggttacggcgattcgtgcacggtgactgtccctcctgagctagtcgccgagttgccgcgccagctctatgtttatcacggctgcgggctgggcgagtatctgagtccggtgcagacgcgcgccgtgatggcgacccgcctcacgtcgttgtgcaaagggttttccggcgtgagcttggaactgctgcaacaaattgtgaagctactccagcgcgatttattgccgttgattccgtcggagggctcggtgggtgccagtggcgatctgactccattatcgtacctcgcggcggttttgtgcggcgagggcgacgtttggcgcagcggcgtccatgtcagcgccgcgcgggcactggccgaggccggcatcacaccgctgcgtctgagacccaaagagggcttggcgatcatgaatgggactgcggtcatgaccgctttggcctgccttgcttatgtgcgcgccgattatctcacccgactggtcactcggatcaccgcgttggcgtcgtttgcgcttgacggcaatgtgcaccatttcgatgccgcgttgttcgccgtgaaaccacatccaggcatgcagcgagtggccggttggttgcgtcaagacttgttctcggatcagctggaccccaacgacaagcgcctacaggatcgctattcgatccgttgcgcgccccacgtgatcggtgttctagccgacgcgctgccctggttgcgcgagtccattgaaaatgagctcaacagcgccaacgacaatcccatcatcgatgcggtaggccaaggcgtgttgtgtggcggtcacttttacggcgggcatatcgcatttgccatggacagcatgaaaaatgccgtcgccaacctggcggatctgctcgaccggcagatggcgctgttggtggatagccgctacagcaatgggctgccggccaacttgtctggagttcaagggccacgcgccccgatcaaccatgggcttaaggggttgcagatcggcgcttcggcctggaccgccgaagcgctcaagttgaccatgccggcgtcggtcttctcgcgttcgaccgagtgccataatcaggacaaagtcagcctcggtactactgccgcacgcgattgtttgcgtgtgctcgaattgacggagcaagttgccgcggcgctgctcattgccgtgcgacaaggagtctggctgcgttgccgactcaatcggtccttggcttcggcgaagacactaaaaaacatgattgacgcgctagccgccgatatccgcgtgatcgaggaggatcgcaagctggaaccggatttgcgattactgttggagcgcatccgcggccgcttctggaaactatatgaataa

SEQ ID NO: 184 - protein, 520 aa, Unknown
  Obtained from environmental sample
  DOMAIN (14)...(492): Phenylalanine and histidine ammonia-lyase
MHAAELKTSALSRTIAFDHGWLKIEDIVDIAEGSARVALSEAAAFHVGIKRGADFLEHLLRQEGTIYGVTTGYGDSCTVTVPPELVAELPRQLYVYHGCGLGEYLSPVQTRAVMATRLTSLCKGFSGVSLELLQQIVKLLQRDLLPLIPSEGSVGASGDLTPLSYLAAVLCGEGDVWRSGVHVSAARALAEAGITPLRLRPKEGLAIMNGTAVMTALACLAYVRADYLTRLVTRITALASFALDGNVHHFDAALFAVKPHPGMQRVAGWLRQDLFSDQLDPNDKRLQDRYSIRCAPHVIGVLADALPWLRESIENELNSANDNPIIDAVGQGVLCGGHFYGGHIAFAMDSMKNAVANLADLLDRQMALLVDSRYSNGLPANLSGVQGPRAPINHGLKGLQIGASAWTAEALKLTMPASVFSRSTECHNQDKVSLGTTAARDCLRVLELTEQVAAALLIAVRQGVWLRCRLNRSLASAKTLKNMIDALAADIRVIEEDRKLEPDLRLLLERIRGRFWKLYE

SEQ ID NO: 185 - DNA, 1566 bp, Unknown
  Obtained from environmental sample
atgcatcccattgacttgaagaagaactcaacctcagtccgtacgattcgtttcgaccatggacggctgaaaatcgaggagattgtcgatatcgcggaagggtcggctagggtagcactgtccgatgcttctgaattccgctccgcgattgcgcgaggggcggactttctggatcgtctgctgcgggaagagggaacaatttatggcgttaccaccggctacggcgattcgtgcaccgtgacggtcccgtttgagttggtcgccgagttgccgcgccatctctacacttatcacggttgcgggctgggggaatatttaagtccggtacagacgcgggccgtgatcgccacccgcctcacatcgttgtgcaaaggattctctggcgtcagtctcgaactgccgcatcaactcgtgaggttgctgcagtgcgatttactgccattgattccctctgaaggttcggtgggcgccagcggcgatctcaccccgctatcctatctcgcagctgtgttgtgcggcgagggcgaagtttggcgcgacggcgtccatacgagcgccgcgcaggcactggctgaggccggtatcgcaccgctacggttgaggccaaaagaaggactggcgatcatgaatgggacgtcggtcatgaccgctttggcgtgccttgcttatgcgcgcgccgattacctcacccggctagtcactcgcatcaccgcattggcgtcgtttgcgctggacggcaatgcgcaccatttcgaggctacgttgttctcagtgaagccgcacccaggccagcatcgggtggccggttggttgcgtcaagacttggcgtgcgatcagctggaccccaacggaaagcgtctccaggatcgctactcgatccgttgcgcgccccacgtgatcggtgttctcgccgatgcgctgccatggttgcgcgagtccatcgaaaatgaactcaacagcgccaacgataatccgatcatcgacgcggagggcgaacgggtgctctatggcggtcacttctacgggggacatattggatttgccatggacagcatgaaaaatgccgtcgcaaacctggcggatctgcttgaccggcaaatggcgctactcgtcgacagccgctacaataatgggttgccggccaacttatctggggttcaagggccacgtgcagcgatcaatcatgggctcaaggggttgcagatcagtgcttcggcatggaccgcggaggcgctcaagttgaccatggcggcgtcggtgttctcgcgttcgaccgagtgccacaaccaggacaaagtcagcatgggtacgattgcggcacgcgattgtttgcgtgtgctcgaattgacggagcaagtcgccgcggcgctgctaatcaccgtgcgacagggggtctggctccgttgcaggctgaatcgatccgtcgctccggaggcgacgttgaagaaaatgatggacgccttgggcgctgatatcgccgagattgaggaggaccgcaggctagagccggatttgcgattattactggagcgcatccgcgaccgtgtctggacattgtatgaataa

SEQ ID NO: 186 - protein, 521 aa, Unknown
  Obtained from environmental sample
  DOMAIN (15)...(494): Phenylalanine and histidine ammonia-lyase
MHPIDLKKNSTSVRTIRFDHGRLKIEEIVDIAEGSARVALSDASEFRSAIARGADFLDRLLREEGTIYGVTTGYGDSCTVTVPFELVAELPRHLYTYHGCGLGEYLSPVQTRAVIATRLTSLCKGFSGVSLELPHQLVRLLQCDLLPLIPSEGSVGASGDLTPLSYLAAVLCGEGEVWRDGVHTSAAQALAEAGIAPLRLRPKEGLAIMNGTSVMTALACLAYARADYLTRLVTRITALASFALDGNAHHFEATLFSVKPHPGQHRVAGWLRQDLACDQLDPNGKRLQDRYSIRCAPHVIGVLADALPWLRESIENELNSANDNPIIDAEGERVLYGGHFYGGHIGFAMDSMKNAVANLADLLDRQMALLVDSRYNNGLPANLSGVQGPRAAINHGLKGLQISASAWTAEALKLTMAASVFSRSTECHNQDKVSMGTIAARDCLRVLELTEQVAAALLITVRQGVWLRCRLNRSVAPEATLKKMMDALGADIAEIEEDRRLEPDLRLLLERIRDRVWTLYE

SEQ ID NO: 187 - DNA, 1566 bp, Unknown
  Obtained from environmental sample
atgcatcccgttgacttgaagaagagctcaacgtcagtccgtacgattagattcgacgatgggcggctgaaaatcgaggatattgttgatatcgcggaagggtcggctagtgtaacactgtccgatgcttttgaattccgctccgccatcgggcgaggggtggattttctggatcgtctgctgcgcgaagagggcacggtttatggcgttaccaccggctacggcgattcatgcaccgtgacggtcccgcttgagttggtggcggagttgccacgccatctctacacttatcacggctgcgggctgggcgcgtacttgagtccggttcagacgcgggcggtgatggcgacccgccttacttctttatgcaaaggattctccggcgtcagtctggaattgctgcaacaaatcgtgaggttgctgcagtgcgatttattgccattgattccatctgaaggttccgtgggggccagcggcggtctcaccccactatcctatctcgctgccgttttgtgcggcgagggcgaagtttggcgtaacggcgttcatgcaaacgccgcgcaagcactggccgaggccggtataacaccgctccggttgaggccaaaggaaggactggcgatcatgaatgggacgtcggtcatgaccgccttggcgggccttgcttatacgcgggccgattacctcacccggctagccactcgcatcaccgccttagcgtcgtttgcgctggacggcaatgcgcaccatttcgatgctacgttgttctcagtgaagcctcacccaggccagcagcgggtggcgggttggttgcgtcaagacttagcgtgcgatcagctggaccccaatggaaagcgtctccaggatcgctactcggtccgttgcgcgccccacgtgatcggtgttctcgccgatgcgctgccatggttgcgtgagtatatcgaaaatgaacttaacagcgccaacgataatcccatcatcgacgcggagggcgaacgcgtactctatggcggtcacttctacggggggcatattggatttgccatggacagcatgaaaaatgccgtcgcaaacctggcggatctgcttgaccggcagatggctctgctggtcgacagccggtatagcaacggcttgccggccaacttgactggggttcaggggccgcgtgcagcgatcaatcatggcctcaaggggttgcagatcagtacttcggcatggaccgcggaggcgctcaagttgaccatgccggcatcggtgttctcgcgttcgaccgagtgccataaccaggacaaggtcagcatgggaaccattgcggcacgggattgtttgcgggtgctcgagttgaccgagcaagtcgctgcggcgatgctgataaccgtacgacagggcgcctggttgcgttgcggcctgaatcggtccaccgcgccagagttgatgctgcgggacatgatggacgcgctgagcaatgatatcccggtgatcgacgaggaccgtaaactggagccggatctgcgattaatgctgcagcggattcgtggtcgtgcctggaagctctatgagtaa

SEQ ID NO: 188 - protein, 521 aa, Unknown
  Obtained from environmental sample
  DOMAIN (15)...(494): Phenylalanine and histidine ammonia-lyase
MHPVDLKKSSTSVRTIRFDDGRLKIEDIVDIAEGSASVTLSDAFEFRSAIGRGVDFLDRLLREEGTVYGVTTGYGDSCTVTVPLELVAELPRHLYTYHGCGLGAYLSPVQTRAVMATRLTSLCKGFSGVSLELLQQIVRLLQCDLLPLIPSEGSVGASGGLTPLSYLAAVLCGEGEVWRNGVHANAAQALAEAGITPLRLRPKEGLAIMNGTSVMTALAGLAYTRADYLTRLATRITALASFALDGNAHHFDATLFSVKPHPGQQRVAGWLRQDLACDQLDPNGKRLQDRYSVRCAPHVIGVLADALPWLREYIENELNSANDNPIIDAEGERVLYGGHFYGGHIGFAMDSMKNAVANLADLLDRQMALLVDSRYSNGLPANLTGVQGPRAAINHGLKGLQISTSAWTAEALKLTMPASVFSRSTECHNQDKVSMGTIAARDCLRVLELTEQVAAAMLITVRQGAWLRCGLNRSTAPELMLRDMMDALSNDIPVIDEDRKLEPDLRLMLQRIRGRAWKLYE

SEQ ID NO: 189 - DNA, 1551 bp, Unknown
  Obtained from environmental sample
atggatccagttcctgaagaagcagcaacggtcgtgttcgacggccggcgccttgcgatcgaggacgtcaccgctttggcgcgtcgcgaacgcacagcgcagctcggtgctaacgccttccgtcagcgcattcagcgcggcgcgaatttcgtggcacgtctgttggccgaagacggcgtgatctatggtgtgaccaccggctacggggattcctgcaccgttgtcatcccgcccgaactggtggccgagctgccgcaccacctgttcgcgtatcacggctgcggcgcgggcgccttgctcacgcccgagcaggtgcgcgccgtgctggccacgcgtctggcctcgctgtcgcaaggcatgtcgggtgtcagcgtagagttgctggaaggtatcgaggcgctgctgcaccacgacatcctgccgctgattccatcggaaggttcggtcggcgcgagtggtgatctgacgccgctgtcctatctggccgccgtgctttgcggtgagcgcgaagtctggttgaagggcgaacgcatgcccgctgccgaagcgctgcaacgctgcgggctcaaagccctgcgcctcaagcccaaggagggcctggccatcatgaacggtacggccgtgatgacggcgctggcctgtctggcttacgagcgtgccgaatacgtggcgcgcctggccaccacgctgacggcgtgcagtgtcgtggccagcgccggcaacgcgcatcacttcgacgaaacgctgttcgccgccaagccccatgccggccagcagaaagtggctgcgcgcctgcgtgcagatctggccagcgacctgcctcagcgcaacgagcagcgcctgcaagaccgctactcgctgcgctgcgcgccgcacgtgatcggcgtgctggaagacaccctgcctttcatgcgccagctgatcgagaacgaactcaacagcgccaacgacaacccgctgatcgatccggacggtcagcgcgtgctgcacggcgggcatttttatggcggccatattgccttggcgatggacaccttgaagaacaccgtcgccaatgtggccgatctgctcgatcgccagctggcgctgctggtggacacgcggttcaaccatgggctgcccagcaacctcagtggcgccaccggcccgcgcgcggccatcaaccatggcttgaaggcactgcagatttcggtttccgcctggaccgccgaagccttgaagcagaccatgccggcctcggtcttcagccgttcgaccgagtgccacaaccaggacaaggtcagcatggggaccatcgctgcgcgcgattgcctgcgcgtgctggaactgaccgagcaggtcgtcgcggccatgctgattgccgcgcgccagggtctggccctgcgtgcgcgccagcagcccctgcagctttcgccagcgctggctgccttgcaaagcgacctcggcgaccgcatcgccatcgtcgacgaagaccgcgcgcttgatggcgatctgcagcgcctgctcgtggctctgcgcacacgctcgtggagcctttatgacgacgcctga

SEQ ID NO: 190 - protein, 516 aa, Unknown
  Obtained from environmental sample
  DOMAIN (10)...(486): Phenylalanine and histidine ammonia-lyase
MDPVPEEAATVVFDGRRLAIEDVTALARRERTAQLGANAFRQRIQRGANFVARLLAEDGVIYGVTTGYGDSCTVVIPPELVAELPHHLFAYHGCGAGALLTPEQVRAVLATRLASLSQGMSGVSVELLEGIEALLHHDILPLIPSEGSVGASGDLTPLSYLAAVLCGEREVWLKGERMPAAEALQRCGLKALRLKPKEGLAIMNGTAVMTALACLAYERAEYVARLATTLTACSVVASAGNAHHFDETLFAAKPHAGQQKVAARLRADLASDLPQRNEQRLQDRYSLRCAPHVIGVLEDTLPFMRQLIENELNSANDNPLIDPDGQRVLHGGHFYGGHIALAMDTLKNTVANVADLLDRQLALLVDTRFNHGLPSNLSGATGPRAAINHGLKALQISVSAWTAEALKQTMPASVFSRSTECHNQDKVSMGTIAARDCLRVLELTEQVVAAMLIAARQGLALRARQQPLQLSPALAALQSDLGDRIAIVDEDRALDGDLQRLLVALRTRSWSLYDDA

SEQ ID NO: 191 - DNA, 1563 bp, Unknown
  Obtained from environmental sample
atgcacctcgctgagctaaagacctcaaccccggcccgtacgattgaattcgacaatggaccccgaaaaatcgaggacattgtggacattgcagaaggatcggcaagcgtgacattgtctgatgcttccgaattccgctccgccattacgcgcggggcggacttcctggactgtctggtgcgcgaagagggcacaatctatggtgtcaccaccggctacggcgattcgtgcaccgtgcccgtgccgcttgagctggtcgccgagttgccgcgccagctctatgtctatcacggttgcgggctgggcgagtatttgagtccggtacagacgcgcgccgtaatagcaacgcgcctcacttcattgtccaagggattctctggcgtcagtcttgaattactccaacagatggtgaggttactgcagtgcgatttattgccgttgattccggctgaagggtcagtgggcgccagcggcgatctcactccgctatcgtacctcgccgcggtgttgtgtggggagggtgaagtttggcgcaacggagtccaggtaagcgccgcgcaggcactgcccgaggctgggatcacaccgctacgactccggccaaaagaaggactggcgatcatgaatggcacagcggtcatgaccgctttggcgtgccttgcttacgtgcgcgccgattatcttacccggctagtgactcgcgtaaccgcactatcgtcatttgcgctcgacggcaatgcccaccatttcgatgctaaattgttctcgctgaagccgcatccaggccagcagcgcgtggcccattggctgcgtcaagatttgtccagcaatcagttggaccccaacggaaagcggctgcaagatcgctattcgatccgctgcgcgcctcacgtgatcggtgttctcgccgatgcgctgccctggctacgcgagtcgattgaaaatgaacttaatagcgccaacgataatcccatcgttgatgcagaaggcaaacccgtattgtatgggggtcatttctacggagggcatatcgcgtttgccatggacagcatgaaaaatgccgtagcaaatctggctgatctgattgaccgccaaatggcactcttggtggatagccgctacaacaatggtttgccggccaacttgtctggggttcaagggccacgtgccacgatcaatcatggactcaaggcgttgcagatcagtgcttcggcgtggacagcggaagcccttaagttgacgatgccggcttcggtgttctcgcgctcgacggagtgtcacaaccaggacaaagtcagcatgggtacgattgcggcacgtgattgtttacgtgtgctcgaattggtggagcaagtcgccgcggcgcttctcatcgctgtgcgacagggagtctggcttcgttgtagactgaatcggtccgtgcttccgggagcaagcttaacggatatgatggacgccctgagcactgatatcaacgtcatagaagaagatcgccgccttgagccggatttgcgactactactagagcggatccgtggccgcgcctggaaactctatgaataa

SEQ ID NO: 192 - protein, 520 aa, Unknown
  Obtained from environmental sample
MHLAELKTSTPARTIEFDNGPRKIEDIVDIAEGSASVTLSDASEFRSAITRGADFLDCLVREEGTIYGVTTGYGDSCTVPVPLELVAELPRQLYVYHGCGLGEYLSPVQTRAVIATRLTSLSKGFSGVSLELLQQMVRLLQCDLLPLIPAEGSVGASGDLTPLSYLAAVLCGEGEVWRNGVQVSAAQALPEAGITPLRLRPKEGLAIMNGTAVMTALACLAYVRADYLTRLVTRVTALSSFALDGNAHHFDAKLFSLKPHPGQQRVAHWLRQDLSSNQLDPNGKRLQDRYSIRCAPHVIGVLADALPWLRESIENELNSANDNPIVDAEGKPVLYGGHFYGGHIAFAMDSMKNAVANLADLIDRQMALLVDSRYNNGLPANLSGVQGPRATINHGLKALQISASAWTAEALKLTMPASVFSRSTECHNQDKVSMGTIAARDCLRVLELVEQVAAALLIAVRQGVWLRCRLNRSVLPGASLTDMMDALSTDINVIEEDRRLEPDLRLLLERIRGRAWKLYE

SEQ ID NO: 193 - DNA, 1563 bp, Unknown
  Obtained from environmental sample
  misc_feature (1)...(1563): n is a, g, c or t
atgcatcccgctgagttgaagatctcgaccttacttcggacggttcaattcgacgatagtcggctgaaaatcgaagacattgtcgatatcgcggaagggtcggctaacgtggcgttgtctgatgctgccgcatttcgctccgggattgagcgaggggcggacttcctggaccgtctgctgcgcgaagcgggcgcgatctatggtgttacgaccggctacggcgattcgtgcacggtgacagtgccgcctgacctggtcgccgagttgccgcgccaactttatatctatcaccgctgtgggctgggcgagtatttgagcccggtgcagacccgcgccgtgatggcgacccgcctcacctcgttgtgcaaagggttttctggcgtgagcttggaactgttgcaacaaatcgtgagattactgcagtgcgatctattgcctttgatcccatcggaaggctcggtgggtgccagcggcgatctcactccgctatcgtacttcgccgcggtgttgtgcggcgagggcgaggtttggcgcaacggtgtccgtgtcagcgccgcacgggcgctggccgaggggggtatcgcgccgctgcgtttgaggcctaaagaagcgttggcgattatgaatgggacggcagtgatgactgctttggcctgccttgcttatgtgcgcgccgactatctcgcccggctggtcacccggatcaccgcgttggcgtcatttgcgctcgacggcaatgcccaccatttcgatgccacgttgttcgcagtaaaaccacatccaggcatgcagcgcgtggccagttggttacgtcaagacttgccgtgcgatcggctgagcccgaacaggaagcgcctgcaggatcgctactcggtccgttgcgcgccccacgtcatcggtgtgctagtcgatgcgctgccatggttgcgcgagtccattgaaaatgaacttaacagtgccaacgacaatcccatcatcgatgtggcaagncagggcgtgctctccggcggtcacttttacggcgggcatatcgcgtttgccatggacagcatgaaaaacgctatcgccaacctggcggacctgctggaccggcagatggcactgttggtggatcgccgttacaacagtggactgccggccaacttgtctgggactcaagggccacgcgccgcgatcaaccatgggctcaaggggttgcagatcagtacttcggcctggactgccgaagcgctcaagctgaccatgccggcgtcggtgttctcgcgttcgaccgagtgccataatcaggacaaagtcagcatgggcacgatcgccgcgcgcgattgcttgcgtgttctcgagttgacggagcaagtcgccgctgcgctgttgatcgccgtgcgccagggcgtctggctccgttgtcggctcaatcggtccttcgctccggagggaacgctgaggagcatgatggacgcgctgggcaccgatatccgtgtgatcgaagaagaccgtagcctcgaaccggatttgcggttgctgctggagcgtatccgtggccgcgcctggaagccgtatgaatga

SEQ ID NO: 194 - protein, 520 aa, Unknown
  Obtained from environmental sample
  SITE (1)...(520): Xaa is any amino acid
MHPAELKISTLLRTVQFDDSRLKIEDIVDIAEGSANVALSDAAAFRSGIERGADFLDRLLREAGAIYGVTTGYGDSCTVTVPPDLVAELPRQLYIYHRCGLGEYLSPVQTRAVMATRLTSLCKGFSGVSLELLQQIVRLLQCDLLPLIPSEGSVGASGDLTPLSYFAAVLCGEGEVWRNGVRVSAARALAEGGIAPLRLRPKEALAIMNGTAVMTALACLAYVRADYLARLVTRITALASFALDGNAHHFDATLFAVKPHPGMQRVASWLRQDLPCDRLSPNRKRLQDRYSVRCAPHVIGVLVDALPWLRESIENELNSANDNPIIDVAXQGVLSGGHFYGGHIAFAMDSMKNAIANLADLLDRQMALLVDRRYNSGLPANLSGTQGPRAAINHGLKGLQISTSAWTAEALKLTMPASVFSRSTECHNQDKVSMGTIAARDCLRVLELTEQVAAALLIAVRQGVWLRCRLNRSFAPEGTLRSMMDALGTDIRVIEEDRSLEPDLRLLLERIRGRAWKPYE

SEQ ID NO: 195 - DNA, 1563 bp, Unknown
  Obtained from environmental sample
  misc_feature (1)...(1563): n is a, g, c or t
atgagcgccaagaaggacgaggtggcctttggccacgcagacctgagcatcgaggacgtggtggcgctggcaaggcgccagagcacggctcgtttgaatgccgaagccggctttgtcgcgcgcatcaaccgcggcgccgacttcatcgaccgacttttgaaagacgagggcgtggtctacggggtgaccaccggttacggcgattcttgcaccgtggctatccccatggcgcaagtggctgagctgccgcatcagctctataccttccatggcctgggcctaggcgctccgttggatgaagccgccacccgttcggtgctggcggcgcgcctggcttcgctgtgccgaggcatgagtggtgttagctatgggctgctaaagcagctggaagcgctgctgctgcatgacttgctgcccgtcatcccccaagagggttccgtcggcgccagcggggacttgacccccctgtcctatgtggcagcagtgctttgcggcgagcgcgaagtgatggatgcgggccgccgccgtcctgcgctggacgcgctgaaagaacgcggccttcagcccttgaccctccgccccaaagagggcttggccatcatgaacggaacagccgtgatgacgggcctggcctgcttggcctggagccgcgccgactacctcagccgcctgagcacacgcatcacggcattggccgtcttggccgtcgatggtaatcccaagcatttcgatgcgggcctcttcgctgccaagccccatcccggcatgctacgcgtggccgcgcgcctgcgcagcgacttgcccgaggctttggccgggcgcaatgagcggcgcctgcaggaccgctacagcctgcgttgcgcgccccatgtcatcggcgtattggaagacgctctgcccttcctgcgccagtggatcgagaccgagctgaacagcgccaacgacaaccccttgatcgacgccgaggatgaacgggtcttgcacggcggccatttctacggcggccacatcgctttcgccatggatagcttgaaggccgctgtggccagcctggccgacctgctggaccgtcaagtggccntgctctgcgaccccaagttcaaccacggcttgcccgccaacctctcgggcagcccggcgcagcgcagcgccttgaaccacggcctgaaggccctctccatcggctgcagcgcctgggccgccgaggctctcaagctgacgatgccggccgcgtccttctcgcgttcaactgaatgccacaaccaggacaaggtgagcatgggcacgatcgccgctcgtgattgcctgcgagtgctggagctcagcgaacaggtagcggccggagctctcgtcgccgccagccaaggtttggatctgcgcctcaaagatcaaggcctcggcgccgacagcttgagccccgcgttagcggccatgcacgcctctctgcgcgccgagcttcccttcctcggtgaggaccgagccctggaaggcgaactgcgccgcctgctggagcgcttccgcgcccaagacttcgacctctatcccctggagccctctgcatga

SEQ ID NO: 196 - protein, 520 aa, Unknown
  Obtained from environmental sample
  DOMAIN (7)...(491): Phenylalanine and histidine ammonia-lyase
  SITE (1)...(520): Xaa is any amino acid
MSAKKDEVAFGHADLSIEDVVALARRQSTARLNAEAGFVARINRGADFIDRLLKDEGVVYGVTTGYGDSCTVAIPMAQVAELPHQLYTFHGLGLGAPLDEAATRSVLAARLASLCRGMSGVSYGLLKQLEALLLHDLLPVIPQEGSVGASGDLTPLSYVAAVLCGEREVMDAGRRRPALDALKERGLQPLTLRPKEGLAIMNGTAVMTGLACLAWSRADYLSRLSTRITALAVLAVDGNPKHFDAGLFAAKPHPGMLRVAARLRSDLPEALAGRNERRLQDRYSLRCAPHVIGVLEDALPFLRQWIETELNSANDNPLIDAEDERVLHGGHFYGGHIAFAMDSLKAAVASLADLLDRQVAXLCDPKFNHGLPANLSGSPAQRSALNHGLKALSIGCSAWAAEALKLTMPAASFSRSTECHNQDKVSMGTIAARDCLRVLELSEQVAAGALVAASQGLDLRLKDQGLGADSLSPALAAMHASLRAELPFLGEDRALEGELRRLLERFRAQDFDLYPLEPSA

SEQ ID NO: 197 - DNA, 1563 bp, Unknown
  Obtained from environmental sample
atgagcgccaagaagaacgaagtggcctttggccacgcagacctgagcatcgaggacgtggtggcgctggcaaagcgccagagcacggctcgtttgaatgccgaagccggctttgtcgcgcgcatcaaccgcggcgccgacttcatcgaccgccttttgaaagatgagggcgtggtctacggggtgaccaccggttacggcgattcttgcaccgtggctatccccatggcgcaagtggctgagctgccgcatcagctctataccttccatggcctgggcctaggcgctccgttggatgaagccgccacccgttcggtcctggcggcgcgcctggcttcgctgtgccgaggcatgagcggtgtcagctatgggctgctaaagcagctggaagcgctgctgctgcatgacttgctgcccgtcatcccccaagagggttccgtcggcgccagcggagacttgacccccctgtcctacgtggccgcggtgctctgcggtgagcgtgaagtaatggatgcgggccgccgccgtcctgcgctggacgcgctgaccgaacgcggcctgcagccgctgaccctccgccccaaagagggcttggctatcatgaacggtacagcggtgatgacgggcctggcctgcttggcctggagccgcgccgactatctcagccgcctgagcacacgcatcaccgcgttggccgtcctggccgtcgatggcaatcccaagcatttcgatgcgggcctcttcgccgccaagccccatccaggcatgctgcgcgtcgctgcgcgcctgcgtagcgacttgcccgcagctctggccggtcgcaatgagcggcggctgcaggaccgctacagcctgcgttgcgctccccatgtcatcggcgtgttggaagacgccctgcccttcctacgccagtgggtcgagaccgagctgaacagcgccaacgacaaccccttgatcgacgccgaggatgaacgggtcttgcacgggggccatttctacggcggccacatcgctttcgccatggatagcctaaaggctgcggtggccagcctagccgacctgctggaccgccaagtggccctgctctgcgaccccaagttcaaccacggcttgcccgccaacctctcgggcagcccggcccagcggagcgccctgaaccacggcctgaaggccctctccatcggctgcagcgcctgggccgccgaggctctcaagctgacgatgccggccgcgtccttctcgcgttcaactgaatgccacaaccaggacaaggtgagcatgggcacgatcgccgctcgtgattgcctgcgagtgctggagctcagcgaacaggtagcggccggagctctcgtcgccgccagccaaggtttggatctgcgcctcaaagatcaaggcctcggcgccgacagcttgagccccgcgttagcggccatgcacgcctctctgcgcgccgagcttcccttcctcggtgaggaccgagccctggaaggcgaactgcgccgcctgctggagcgcttccgcgcccaagacttcgacctctatcccctggagccctctgcatga

SEQ ID NO: 198 - protein, 520 aa, Unknown
  Obtained from environmental sample
  DOMAIN (7)...(491): Phenylalanine and histidine ammonia-lyase
MSAKKNEVAFGHADLSIEDVVALAKRQSTARLNAEAGFVARINRGADFIDRLLKDEGVVYGVTTGYGDSCTVAIPMAQVAELPHQLYTFHGLGLGAPLDEAATRSVLAARLASLCRGMSGVSYGLLKQLEALLLHDLLPVIPQEGSVGASGDLTPLSYVAAVLCGEREVMDAGRRRPALDALTERGLQPLTLRPKEGLAIMNGTAVMTGLACLAWSRADYLSRLSTRITALAVLAVDGNPKHFDAGLFAAKPHPGMLRVAARLRSDLPAALAGRNERRLQDRYSLRCAPHVIGVLEDALPFLRQWVETELNSANDNPLIDAEDERVLHGGHFYGGHIAFAMDSLKAAVASLADLLDRQVALLCDPKFNHGLPANLSGSPAQRSALNHGLKALSIGCSAWAAEALKLTMPAASFSRSTECHNQDKVSMGTIAARDCLRVLELSEQVAAGALVAASQGLDLRLKDQGLGADSLSPALAAMHASLRAELPFLGEDRALEGELRRLLERFRAQDFDLYPLEPSA

SEQ ID NO: 199 - DNA, 1563 bp, Unknown
  Obtained from environmental sample
atgcatcccgctgatcacaagaacgcggcctcagggcgtacaatcgtgttcggcaatgggccggtgagaatcgagaacattgtcgacatcgcagaggagtcggtctgtgtcgcattgtctgattcccatgaattctgcagcgccattaaccgagggacggattttctcgatcgtttgcttcgtgaagagggtgcgatctatggcgtcaccaccggctacggcgattcgtgtaccgtggcggtcccggttgagctggtgggcgaactgccgcgttatctctacgcctatcacggctgcgggctgggcgcgtatttgagcccggtacagacgcgggcggtgatggcgacccgcctcacctcactgtgcaaaggattctccggcgtcagtctggaattgctgcagcaaatcgtgaggctcctgcggtgcgatatattgccgttgattccatccgaaggctcagtgggtgccagcggtgatctgactccgttatcgtatcttgctgccgttttgtgcggcgagggtgaagtttggcgcaacggtgtccgtacatgcgccgctcaggcactatatgaggccgggctgacgccgctccggttaaggccaaaagaaggcctggcgatcatgaacgggacatcggtaatgactgctttggcttgccttgcttattcacgggccgagtacctcacgcggctggtcacgcgcatcaccgccttggcgtcgtttgcgcttgacggcaacgcgcatcattttgatgccaagttattttcggtgaagccgcatcctggcctgcagcgcgtggctggttggttgcgtcaagacttgccgtgcgatcagcgggaccgcaatggaaagcgactccaggatcgctattcggtacgttgcgcgccacacgtgatcggtgtactagccgacgcgatgccatggttgcgcgatgccatcgaaaatgaacttaacagcgtcaacgacaatccgatcatcgatgcggaaggcgaagccgtactgtgtggcggacacttttacggtggacacatcgcgtttgcgatggacagtatgaaaaatgctgtcgcaaacctcgctgatctccttgaccggcagatggcgctactggtcgacagccgctacaacaacggcttgccggccaacttgtccggagttcaagggccgcgtgcagcgatcaatcatggactcaaagggttgcagatcagtgcttcggcatggactgcggaggcgctcaagttaacgatgccggcttcggtattctcgcgttcgaccgagtgccacaaccaggacaaagtcagcatggggaccattgcggcacgggattctttgcgggtgctcgagctgaccgagcaagtcgctgcggcgatgctgataaccgtgcgacaaggggtctggctacgttgccgcctccatcagtccatcgcgccagagagggtgctgcaggagatgattgacgcgttaagcggggatatcccggtgatcgatgaggaccgcaaactggagccagatctgcgattaatgctggagcggattcgtggtcgtgcctggaagctctatgaataa

SEQ ID NO: 200 - protein, 520 aa, Unknown
  Obtained from environmental sample
MHPADHKNAASGRTIVFGNGPVRIENIVDIAEESVCVALSDSHEFCSAINRGTDFLDRLLREEGAIYGVTTGYGDSCTVAVPVELVGELPRYLYAYHGCGLGAYLSPVQTRAVMATRLTSLCKGFSGVSLELLQQIVRLLRCDILPLIPSEGSVGASGDLTPLSYLAAVLCGEGEVWRNGVRTCAAQALYEAGLTPLRLRPKEGLAIMNGTSVMTALACLAYSRAEYLTRLVTRITALASFALDGNAHHFDAKLFSVKPHPGLQRVAGWLRQDLPCDQRDRNGKRLQDRYSVRCAPHVIGVLADAMPWLRDAIENELNSVNDNPIIDAEGEAVLCGGHFYGGHIAFAMDSMKNAVANLADLLDRQMALLVDSRYNNGLPANLSGVQGPRAAINHGLKGLQISASAWTAEALKLTMPASVFSRSTECHNQDKVSMGTIAARDSLRVLELTEQVAAAMLITVRQGVWLRCRLHQSIAPERVLQEMIDALSGDIPVIDEDRKLEPDLRLMLERIRGRAWKLYE

SEQ ID NO: 201 - DNA, 1563 bp, Unknown
  Obtained from environmental sample
atgcatcccgctgaccagaagaacgcaaccacagcccgtacaattaaactcgacaatggtcggctgagaatcgaggacattatcgatatcgcggaggggtcggcccgtgtcgttttgtccgattcgcatgaattctgcgccgccattaaccgaggggcggattttcttgaccgtttgctgcgtgaagagggtacgatctatggtgtcaccaccggctacggcgattcgtgcaccgtgacggtcccggttgagctgatcggcgagctgccgcgccatctctacacctatcacggctgtgggctgggcgagtatttgagtccggtacagacacgcgcagtgatggcgactcgcctcacatcgttgtgcaaagggttctccggcgtcagtctggaactgctgcggcaaatcgtgaagttactccagtgcgatctattaccattgattccatccgaaggctcagtgggtgccagcggtgatctcactccgttatcgtaccttgctgccgttttgtgcggcgagggtgaaatttggcgaaacggcgcccgtttaagcgccgctcacgcactgactgaggcagggatgaaaccgctgcggttgaggccaaaagaaggactggcgatcatgaacgggacgtcggtaatgaccggtttggcttgccttgcgtatgcacgtgccgattatctcacccggctggtcactcgcatcaccgccctagcttcctttgcgcttgacggcaacgcgcagcattttgatcctaagttattctcggtgaagccgcatccaggcctgcagcgcgtggcgggctggttgcgtcaagacttgccgtgcgatcggcgtgaccgcaacggaaagcgtctacaggaccgttattcggtgcgttgcgcgccccacgtaatcggtgttctagcagacgccacgccgtggctgcgcgactccatcgaaaatgaactcaacagcgccaacgacaatcccatcattgatgcggaaggcgaacgcgtgctgtatggtggccacttttacggtgggcatatcgcgtttgccatggacagcatgaaaaatgccgtcgcaaacctggcggatctgcttgaccggcagatggccctgctggtcgacagccgctacaacaatggtttggcggccaacttgtctggagctcatgggccacgtgcaaccatcaatcatgggctcaagggcttgcagattagtgcttcggcatgggcggcggaagcgctcaagttaacgatgccggcgtcggtgttctcgcgttcgaccgagtgccacaatcaggataaagtcagcatgggcaccattgcggcacgggattctctgcgggtgctcgagctaaccgagcaggtcgctgccgcgatgctgatagccgtgcgacaaggtgtctggctgcgttgccggctgaaccgatccatggctccggaggcgacgctgcggaacatgatggacgcgctaggcgctgatatcccggtaatcgaggaggaccgcaagctagagccggatctcagactaatgctggagcgcattcgctgtcgggcctggaagctatatgaataa

SEQ ID NO: 202 - protein, 520 aa, Unknown
  Obtained from environmental sample
MHPADQKNATTARTIKLDNGRLRIEDIIDIAEGSARVVLSDSHEFCAAINRGADFLDRLLREEGTIYGVTTGYGDSCTVTVPVELIGELPRHLYTYHGCGLGEYLSPVQTRAVMATRLTSLCKGFSGVSLELLRQIVKLLQCDLLPLIPSEGSVGASGDLTPLSYLAAVLCGEGEIWRNGARLSAAHALTEAGMKPLRLRPKEGLAIMNGTSVMTGLACLAYARADYLTRLVTRITALASFALDGNAQHFDPKLFSVKPHPGLQRVAGWLRQDLPCDRRDRNGKRLQDRYSVRCAPHVIGVLADATPWLRDSIENELNSANDNPIIDAEGERVLYGGHFYGGHIAFAMDSMKNAVANLADLLDRQMALLVDSRYNNGLAANLSGAHGPRATINHGLKGLQISASAWAAEALKLTMPASVFSRSTECHNQDKVSMGTIAARDSLRVLELTEQVAAAMLIAVRQGVWLRCRLNRSMAPEATLRNMMDALGADIPVIEEDRKLEPDLRLMLERIRCRAWKLYE

SEQ ID NO: 203 - DNA, 1563 bp, Unknown
  Obtained from environmental sample
atggatcccgctgacctgaaggcctcaaccttacctcggacgattgaattcgaccagggatggctgaaaatcgaagacattgtcgacatcgccgaagggtcggctagggtggcgttgtccgatactgctgcatttcgctctggcattaagcgaggcgcagccttcctggaccgtctgctgcacgaagagggcacgatctacggcgttactaccggctacggcgattcgtgcacggtgacggtgccgcttgagctggtcgccgagttgccgcgtcagctctatatctatcacggctgtgggttgggcgagtacctgagtccggtacagacgcgcgccgtgatggcgacccgcctcacatcgttgtgcaaagggttttctggcgtgagcttggaactgctgcaacaaatcgtgaggttactccagtgcgatttattgccattgattccgtcggaaggctcggtgggtgccagcggcgatctcactccgctatcgtatctcgctgcggttttgtgcggcgagggcgacgtttggcgtaacggcgtccatgtaagcgccgcgcaggcactggccgagggcggtatcacaccgctgcgtttgaggcccaaagaagggttggcgatcatgaatgggacggctgtcatgaccgctttggcctgccttgcttatgtgcgcgccgattatctcacccgactggttactcggaccaccgcactggcgtcgtttgcgcttgacggtaatgcccaccatttcgatgccacgttgttcgcagtgaaaccgcatccgggcatgcagcgagtggccggttggttgcgtcaagatttgccgtgcgatcacctggacaccaatagaaagcgtctgcaggatcgctattcgctccgctgcgcgccccacgtgatcggtgttctagccgacgcgctgccatggttgcgcgagtccatcgaaaatgaactcaacagtgctaacgacaatcccatcatcgatgcggaaggccaaggtgtcctgtctggcggtcatttttacggcgggcatatcgcatttgccatggacagcatgaaaaatgccgtcgctaacctggcggatctgctcgatcggcaaatggcactgctggtcgatggccgctacaacaatgggctgccggccaacttgtctggggctcaaggcccgcgcgccgcgatcaatcatgggctcaaggggttgcagatcagcgcttcggcatggactgcggaagccctcaagttgaccatgccggcctcggtgttctcgcgctcgaccgagtgccataaccaggacaaagttagtctgggtacgattgcggcacgcgattgtttgcgggtgctcgaattgacggagcaagtcgccgccgcgctgctcattgcggtacgacaaggagtctggctccgttgcaggctgaatcgatccgtcgctttgggaatggcgctaaggaacatgatggatgccctgagcaccgacatcaacgcgatagaggaagatcgtcgactggagccggatttgcgattactcctggagcgcatccatagccgcgtctggaagctgtatgaataa

SEQ ID NO: 204 - protein, 520 aa, Unknown
  Obtained from environmental sample
MDPADLKASTLPRTIEFDQGWLKIEDIVDIAEGSARVALSDTAAFRSGIKRGAAFLDRLLHEEGTIYGVTTGYGDSCTVTVPLELVAELPRQLYIYHGCGLGEYLSPVQTRAVMATRLTSLCKGFSGVSLELLQQIVRLLQCDLLPLIPSEGSVGASGDLTPLSYLAAVLCGEGDVWRNGVHVSAAQALAEGGITPLRLRPKEGLAIMNGTAVMTALACLAYVRADYLTRLVTRTTALASFALDGNAHHFDATLFAVKPHPGMQRVAGWLRQDLPCDHLDTNRKRLQDRYSLRCAPHVIGVLADALPWLRESIENELNSANDNPIIDAEGQGVLSGGHFYGGHIAFAMDSMKNAVANLADLLDRQMALLVDGRYNNGLPANLSGAQGPRAAINHGLKGLQISASAWTAEALKLTMPASVFSRSTECHNQDKVSLGTIAARDCLRVLELTEQVAAALLIAVRQGVWLRCRLNRSVALGMALRNMMDALSTDINAIEEDRRLEPDLRLLLERIHSRVWKLYE

SEQ ID NO: 205 - DNA, 1557 bp, Unknown
  Obtained from environmental sample
atgatttttggacgaaataacatgcgtgtgttaaccgtaggtgaacaaccactgagtattgaagatgtcgtttctgtagcaagaggcgaatgtcaggttgctttaccagaaacgtctgagtggcgtggactgattcaaaaaggcgctgattttctcgatcagctccttgaagaagaaggggttatctacggggtgaccacgggttatggtgactcatgtttggttgaagtgccattacatcaggttaatgaactaccgctacatctttcacgctttcatggttgtggtttaggtgaaaatttagatgtcatcactgcacgtgcagtagttgtgacacgtttatgttcattggctcgcggttattcgggtgtatcaatagcactacttgagcgcttggtatggttgctgaacgaaaatgtaattccagtcattccctctgaaggttcagtcggggcaagcggggacttaacgccgttgtcttacattgcgggaattttagtcggtgagcgtgatgtgtatgttgatgggaatattgttccagttgctcaggtgtatgctgaaaaaggcttgcagcctttaacgctcagaccaaaagaaggtttggcgctcatgaacggcacagcagtgatgacagcaattgcttgtctaaactataaaaaagcagagcagatagcacttgctagtactttaattactgctctaaatgttttggccttggaaggtaatcctagtcattttgatgaagtactgtttgcacagaaacctcatccgggacagcaacagattgccaagcaattacgtgactggctgaatagtgaagtacaaacagcacatcaaagcccacgtttgcaagaccgttattcgcttcgttgtgcaccacacattattggtgtatttgaagactcaaaagtatggttgcgtcagtttattgaaaatgagctgaattcaagtaacgacaatccactaattgatcctgtaggaatgcgtgtattacatggcggtcatttttacggtgggcacattgcacaagcaatggatagcttaaaaattatgattgccaatattgctgatctgatggatagacagattgcacaactagtcgatcataaaatgaatcatggtttaccgcgtaatttaaccggtgcaacggctgaacgtttaccattgaatcatggttttaaagcggtacaaattggggtgtcggcgtggacggctgaagccttgaaaaatactttagctgcttcaattttttcacgttcaaccgaatgtcataaccaagacaaagtcagtatgggaaccattgctgcgcgtgatgcgagccgtgtgattaccctgacacagcaagtcattgcagcactttgctgcgcgagtgtgcaggcgattcatttaaaaggtttaactgcacagttaagtccgacattgcaggcatttatgcaatggaccttacaaagctttgcatttgtcgaagaagaccgaccattacaaaccgaattacaacagattgttgatcgtttagaccaacttgaattgtttaatcaaccagaatttatgggataa

SEQ ID NO: 206 - protein, 518 aa, Unknown
  Obtained from environmental sample
MIFGRNNMRVLTVGEQPLSIEDVVSVARGECQVALPETSEWRGLIQKGADFLDQLLEEEGVIYGVTTGYGDSCLVEVPLHQVNELPLHLSRFHGCGLGENLDVITARAVVVTRLCSLARGYSGVSIALLERLVWLLNENVIPVIPSEGSVGASGDLTPLSYIAGILVGERDVYVDGNIVPVAQVYAEKGLQPLTLRPKEGLALMNGTAVMTAIACLNYKKAEQIALASTLITALNVLALEGNPSHFDEVLFAQKPHPGQQQIAKQLRDWLNSEVQTAHQSPRLQDRYSLRCAPHIIGVFEDSKVWLRQFIENELNSSNDNPLIDPVGMRVLHGGHFYGGHIAQAMDSLKIMIANIADLMDRQIAQLVDHKMNHGLPRNLTGATAERLPLNHGFKAVQIGVSAWTAEALKNTLAASIFSRSTECHNQDKVSMGTIAARDASRVITLTQQVIAALCCASVQAIHLKGLTAQLSPTLQAFMQWTLQSFAFVEEDRPLQTELQQIVDRLDQLELFNQPEFMG

SEQ ID NO: 207 - DNA, 1554 bp, Unknown
  Obtained from environmental sample
atgaaacatccactacgcactattcaattcgatcagaacaatcttagtatcgaagatatcgttgatatcgcgcaaggttccgtcaatgtcaaattatcggatgctgagcaatttcgggctgctattgctcatggagctgattttttagatcggttattacgtgaagatggaactgtgtatggagtaactaccggatttggtgattcctgcacggtagtagtaccgtcagagttggtagcagaattaccacaccgtctttatacttatcatggctgcggtttgggagaatattttaatcccgcacaaacccgtgccatcattgccacacgtttaacttctttatgcaaaggctattccggcgtcagcgtgaaattattggaacaaattactgcgttattacagcatgatttattgccgttaatgccgtgtgaaggttcagtgggcgccagtggcgatctgactcctttatcttatttagcagcagtattatgcggcgaacgtgaagtgtggtgcaataatgaacgtattcccgcagcgcaagcattaacaaatatcggtttacggccattaaaattacaacccaaagaggggcttgccattatgaacggcaccgccgtgatgactgcattagcttgcctggcttatgcgcgcgctgattacttatcccgcattgcaacgcgcatcactgccatggcaagtttcgctttagacggcaacgcgcatcattttgatgaaattttattttctgtaaaaccccatgcgggtcaacagcaagttgccgcttggttacggcaagatttattatgtgatgtaacgccgcgcaatgaaaaacgtttgcaggatcgttactccattcgctgtgcgccgcatgttataggtgtgctggtcgatgcattaccttggttacgtacatcgattgaaaacgaacttaacagtgctaacgataatccgatcatcgatgcagaaaatgaacgcgtgttacatggtggccatttttatggcggccatattgcatttgctatggatagtttaaaaaatctcgttgctaacattgctgatttgctcgatagacaaatggccttattagtagacaatcgttataaccatggtttgccagccaatttatcgggtgcaaaaggcgctcgtgctgccatcaatcatggtcttaaagctttgcaaattagtgtatcggcctggacagcagaggcattaaaattaactatgccggcatcggttttttcccgatcaacagaatgtcataatcaagataaagttagcatgggcactatcgctgcacgtgattgtttgcgcgttttagaattaaccgaacaagtagttgctgcactactcattaccgtgcgccaaggcgtgtggttacgttccgcattaaaaccggagcacgcattaattgatttacccgctaaacgcttggcgcagatgcaaacgtcattagcaaccgatattcctgtgattgaagaagatcgcatgttagaacctgaattacgattattattagatcgcattcgcgcgcgcgcctggaaattatatgaataa

SEQ ID NO: 208 - protein, 517 aa, Unknown; identical to SEQ ID NO: 106
  Obtained from environmental sample
  DOMAIN (7)...(482): Phenylalanine and histidine ammonia-lyase
  SITE (14)...(17): N-glycosylation site. Prosite id = PS00001
  SITE (147)...(163): Phenylalanine and histidine ammonia-lyases signature. Prosite id = PS00488
  SITE (205)...(208): N-glycosylation site. Prosite id = PS00001
  SITE (379)...(382): N-glycosylation site. Prosite id = PS00001

SEQ ID NO: 209 - DNA, 1563 bp, Unknown
  Obtained from environmental sample
atggccgttgacttgaagaagagctcaacctcagtccgtacgattcaattcgaccatggacggctgaaaatcgaggatattgtcgatatctcggaagggtcggttcgcgtagcactgtccaatgcttctgaatttcgttccgcgattgcgcgaggggcggattttttggatcgtctgctgcgcgaagagggcacgatttatggcgtcaccaccggctacggcgattcatgcaccgtggcggtcccgcctgagctggtcgccgagttgccgcgccagctctatgtttatcacggctgtgggctgggcgagtatttgagtccgctacagacgcgggccgtgatcgccacccgcctcacatcgttgtgcaaaggactctctggcgtcagtctggaactgctgcatcaactcgtgaggttgctgcagtacgatttattgccattgattccatctgaaggttcggtgggggctagcggcgatctcactccgctatcctatctcgctgccgtgttgtgcggcgagggcgaagtttggcgcaacggcgtccatgtaagcgcagcgcacgcactggctgaggccggtatcgcaccgctgcggttgaggccaaaagaaggactggcgattatgaatgggacgtctgtcatgaccgctttggcgtgccttgcatatgggcgcgccgattacctcacgcggctagttactcgcatcacggcgttggcgtcgtttgcgctggacggcaatgcgcatcatttcgatgctacgttgttctcagtgaagccgcatccaggccagcagcgggtggccggttggttgcgtcaagacttggcgtgcgatcagctggaccccaacggaaagcgcctccaggatcgctactcgatccgttgcgccccacacgtgatcggtgttctggccgatgccctgccatggttgcgcgactccatcgaaaatgaactcaacagcgctaacgacaatccgatcatcgatgcggagggcgaacgtgtgctctatggcggtcacttctatggggggcatattggatttgccatggacagcatgaaaaatgccgtcgcaaacctggcggatctgcttgaccggcaaatggcactgctggtcgacagccgctatagcaacggcttgccggccaatttatctggggttcaagggccacgtgcggcgatcaatcatgggctcaaggggttgcagatcagtactttggcatggacggcagaagccctcaagttgaccatgccggcgtcagtgttctcgcgttcgaccgagtgtcacaaccaggacaaagtcagcatgggtaccattgcggcacgcgattgtttgcgtgtgctcgaattgactgagcaagtcgccgcggcgcagctgatcaccgtgcgacagggagcctggctccgttgcaggctgaatcgatccgtcgctccagaggcgacgttgaagaacatgatggacgccttgggcgctgatatcgctgagattgaggaggaccgcaggctagagccggatttgcgattactgctggagcggatccgcgaccgtgcctggaaattgtatgaataa

SEQ ID NO: 210 - protein, 520 aa, Unknown
  Obtained from environmental sample
MAVDLKKSSTSVRTIQFDHGRLKIEDIVDISEGSVRVALSNASEFRSAIARGADFLDRLLREEGTIYGVTTGYGDSCTVAVPPELVAELPRQLYVYHGCGLGEYLSPLQTRAVIATRLTSLCKGLSGVSLELLHQLVRLLQYDLLPLIPSEGSVGASGDLTPLSYLAAVLCGEGEVWRNGVHVSAAHALAEAGIAPLRLRPKEGLAIMNGTSVMTALACLAYGRADYLTRLVTRITALASFALDGNAHHFDATLFSVKPHPGQQRVAGWLRQDLACDQLDPNGKRLQDRYSIRCAPHVIGVLADALPWLRDSIENELNSANDNPIIDAEGERVLYGGHFYGGHIGFAMDSMKNAVANLADLLDRQMALLVDSRYSNGLPANLSGVQGPRAAINHGLKGLQISTLAWTAEALKLTMPASVFSRSTECHNQDKVSMGTIAARDCLRVLELTEQVAAAQLITVRQGAWLRCRLNRSVAPEATLKNMMDALGADIAEIEEDRRLEPDLRLLLERIRDRAWKLYE

SEQ ID NO: 211 - DNA, 1563 bp, Unknown
  Obtained from environmental sample
atgcatcccgctaaccacgtaaccgcaacctcagggcgtacaattaggttcgacaatgggccggtgagaatcgaggacattgtcggcatcgcggaggggtcggcccatgtcgtattgtccgattcccacaaattctgcggagccattaaccgggggacggattttctcgatcgtttgctgcgtgaagagggtgcgatctatggcgtcacgaccggctacggcgattcgtgcacggtggtggttcctgttgagcttgtgggcgaactgccgcgtcatctctacacctatcacggctgcgggctgggcgcgtatttgactccggtacagacgcgggcggtaatggcgacccgcctgacctcgttatgcaaggggttctccggcgtcagcctggaattgctgcagcaaatcgtgaggctacttcagtgcgatatactgcctttgattccatccgaaggctcagtgggtgccagcggtgatctgactccgctatcgtattttgctgccgttttgtgcggtgagggtgaagtttggcacaacggcgtccgtgtaagcgctgctcaggcgctgtctgaagcggggctgacgccgctgcgattgaggccaaaagaaggactggcgaccatgaacgggactgcggtaatggccgctttggcttgcctagcgtttacacgcgccgagtatctgacgcggctggtcactcgcatcacggccctggcgtcatttgcgcttgacggcaacgcgcaccattttgatgccaagttattttcagtgaagccgcgtcctggagtgcagcgcgtggctggttggttgcgtcaagacctgccgtgcgatcagcgggaccgcaacggaaaacgtctccaggatcgttattcgatacgttgcgcgccccacgtgatcggtgtgctagccgatgcaacgccatggttgcgcgctaccatcgaaaatgagctcaacagcgtcaacgacaatcccatcatcgatgccgaagacgaagccgtactgtatagcggccacttttacggtggacacatcgcgtttgcgatggacagcatgaaaaatgctgtagcaaacctggcggatctccttgaccggcagatagcgctgctggtcgacagccgctacaacaatggcttgccggccaacttgtcgggagctcaaggaccgcgtacagcgatcaatcatgggctcaaagggttgcagatcagtgcttcggcatggactgcggaggcgctcaagttaacgatgccggcttcggtgttctcgcgctcgactgagtgccataaccaggacaaggtgagcatggggaccattgcggcacgggattgtttgcgggtgctcgagctgaccgagcaagtcgctgcggcgatgctgataaccgtgcgacaaggcgtctggttgcgttgccgcctgaatcggttcatcacaccagacatgacgctgcgggacatgatggacgcgctaagcaatgagattccagtgatcgacgaggaccgtaaactggagccggatctgcgattaatgctggagcggattcgtggtcgcgcctggaagctctatgagtaa

SEQ ID NO: 212 - protein, 520 aa, Unknown
  Obtained from environmental sample
MHPANHVTATSGRTIRFDNGPVRIEDIVGIAEGSAHVVLSDSHKFCGAINRGTDFLDRLLREEGAIYGVTTGYGDSCTVVVPVELVGELPRHLYTYHGCGLGAYLTPVQTRAVMATRLTSLCKGFSGVSLELLQQIVRLLQCDILPLIPSEGSVGASGDLTPLSYFAAVLCGEGEVWHNGVRVSAAQALSEAGLTPLRLRPKEGLATMNGTAVMAALACLAFTRAEYLTRLVTRITALASFALDGNAHHFDAKLFSVKPRPGVQRVAGWLRQDLPCDQRDRNGKRLQDRYSIRCAPHVIGVLADATPWLRATIENELNSVNDNPIIDAEDEAVLYSGHFYGGHIAFAMDSMKNAVANLADLLDRQIALLVDSRYNNGLPANLSGAQGPRTAINHGLKGLQISASAWTAEALKLTMPASVFSRSTECHNQDKVSMGTIAARDCLRVLELTEQVAAAMLITVRQGVWLRCRLNRFITPDMTLRDMMDALSNEIPVIDEDRKLEPDLRLMLERIRGRAWKLYE

SEQ ID NO: 213 - DNA, 1548 bp, Unknown
  Obtained from environmental sample
atgaacacttcaacctcgacccgcaggattacgttcgacaacggaccggtgagaatcgaggacattgtggacatcgcggcagggtccgcaagcgtggcattgtctgatcgttccgaatttcgcgcagtcattacccgaggggcggaccttctggactgtctggcgcgcgaagagagcacgatctatggcgtcaccaccggctacggcgattcatgcaccgtaacagtcccgttcgagttggtcgccgagctgccacgccatctctatacgtatcacggctgcgggctgggggagtatttaagtccggcacagacgcgtgccgtgatcgcaacccgcctcacgtcactgtccaaaggcttctctggtgtcagtctggaactactggaacagatggtgcggctactgcagtgcgatttattgccattgatcccatctgaaggttcggtgggtgccagcggcgatctaactccgctatcctacctcgccgctgttttgtgcggcgagggtgaagtttggcgcaacggtgtccaggtaggcgccgcgcaggcactgtctgaggccggtatcgcgccgctgcgactacgtcccaaagaaggactggccatcatgaacggaacggccgtcatgacggctttggcgtgcctcgcttacgtgcgcgccgattatattgcccggctagcaacgcgcattaccgcattggcatcgtttgcgctcgacggcaatgcgcaccatttcgatgcgacgctattcgcagtgaagccgcatccaggccagcagcgcgtggccggttggctgcgccgagacctgccgtgcgatcagctggatcccaacggaaagcgtctgcaggaccgctattcgatacgttgtgcgccgcacgtgatcggtgttctcgccgacgctctgccctggttgcgcgagttcatcgaaactgaacttaatagcgccaacgataatccgatcgttgacccggagagcaaaagcgtactatacggcggtcatttttacggtgggcacatcgcgtttgccatggacagcatgaaaaatgccgtcgccaacctagcggatctgatggaccggcagatggcgctgctggtggatacccgctacaacaatggtttgccggccaacttgtccggggttcaagggccgcgtgcagcgatcaaccatgggctcaaggcgttgcagatcagcgcgtcggcatggacggccgaagcgctcaagttgaccatgccggcgtcggtgttctcgcgctcgacggaatgccataaccaggacaaggtcagcatgggtacgattgcggcacgcgattgtttgcgggtgctcgaattggtcgagcaagtcgccgcggcgctgctcatcgctgtgcggcagggagtctggctccgttgtagactgaatcggtccccgcttccggggacaaccttaaagaacatgatggacgcgctgggcgctgatatcagcgtgatcgaggaagatcgtcgacttgagccggatttgcgtttgctgctggagcggatccgcagccgcgcttggaaactgtatgggtaa

SEQ ID NO: 214 - protein, 515 aa, Unknown
  Obtained from environmental sample
MNTSTSTRRITFDNGPVRIEDIVDIAAGSASVALSDRSEFRAVITRGADLLDCLAREESTIYGVTTGYGDSCTVTVPFELVAELPRHLYTYHGCGLGEYLSPAQTRAVIATRLTSLSKGFSGVSLELLEQMVRLLQCDLLPLIPSEGSVGASGDLTPLSYLAAVLCGEGEVWRNGVQVGAAQALSEAGIAPLRLRPKEGLAIMNGTAVMTALACLAYVRADYIARLATRITALASFALDGNAHHFDATLFAVKPHPGQQRVAGWLRRDLPCDQLDPNGKRLQDRYSIRCAPHVIGVLADALPWLREFIETELNSANDNPIVDPESKSVLYGGHFYGGHIAFAMDSMKNAVANLADLMDRQMALLVDTRYNNGLPANLSGVQGPRAAINHGLKALQISASAWTAEALKLTMPASVFSRSTECHNQDKVSMGTIAARDCLRVLELVEQVAAALLIAVRQGVWLRCRLNRSPLPGTTLKNMMDALGADISVIEEDRRLEPDLRLLLERIRSRAWKLYG

SEQ ID NO: 215 - DNA, 1563 bp, Unknown
  Obtained from environmental sample
atgcccgttgacttgaagaagagctcaacctcagtccgtacgattcaattcgacgatggacggctgcaaatcgaggatattgtcgatatctcggaagggtcggttcgcgtagcactgtccaatgcttctgaatttcgttccgccattgcgcgaggggcggactttttggatcgtctgatgcgcgaagagggcacgatttatggcgtcaccaccggctacggcgattcatgcaccgtggcggtcccgcctgagctggtcgccgagttgccgcgccagctctatgtctatcacggctgtgggctgggcgagtatttgagtccgctgcagacgcgggccgtgatcgccacccgcctcacatcgttgtgcaaaggactctctggcgtcagtctggaactgctgcatcaactcgtgaggttgctgcagtacgatttattgccattgattccatctgaaggttcggtgggggctagcggcgatctcactccgctatcctatctcgctgccgtgttgtgcggcgagggcgaagtttggcgcaacggcgtccatgttagcgcagcgcacgcactggctgaggccggtatcgcaccgctgcggttgaggccaaaagaaggactggcgattatgaatgggacgtccgtgatgaccgctttggcgtgccttgcttatgggcgcgccgattacctcacgcggctagttactcgcatcacggcattggcgtcgtttgcgctggacggcaatgcgcatcatttcgatgctacgttgttctcagtgaagccgcatccaggccagcagcgggtggccggttggttgcgtcaagacttggcgtgcgatcagctggaccccaacggaaagcgcctccaggatcgctactcgatccgttgcgccccacacgtgatcggtgttctcgccgatgccctgccatggttgcgcgactccatcgaaaatgaactcaacagcgctaacgacaatccgatcatcgatgcggagggcgaacgtgtgttctatggcggtcacttctatggggggcatattggatttgccatggacagcatgaaaaatgccgtcgcaaacctggcggatctgctcgaccgacaaatggcactgctggtcgacagccgctatagcaacggcttgccggccaatttatctggggttcaagggccacgtgcggcgatcaatcatgggctcaaggggttgcagatcagtacttcggcatggacggcagaagccctcaagttgaccatgccggcgtcagtgttctcgcgttcgaccgagtgtcacaaccaggacaaagtcagcatgggtaccattgcggcacgcgattgtttgcgtgtgctcgaattgactgagcaagtcgccgcggcgctgctgatcaccgtgcgacagggagcctggctccgttgcaggctgaatcgatccgtcgctccagaggcgacgttgaagaacatgatggacgccttgggcgctgatatcgctgagattgaggaggaccgcaggctagagccggatttgcgattactgctggagcggatccgcgaccgtgcctggaaattgtatgaataa

SEQ ID NO: 216 - protein, 520 aa, Unknown
  Obtained from environmental sample
MPVDLKKSSTSVRTIQFDDGRLQIEDIVDISEGSVRVALSNASEFRSAIARGADFLDRLMREEGTIYGVTTGYGDSCTVAVPPELVAELPRQLYVYHGCGLGEYLSPLQTRAVIATRLTSLCKGLSGVSLELLHQLVRLLQYDLLPLIPSEGSVGASGDLTPLSYLAAVLCGEGEVWRNGVHVSAAHALAEAGIAPLRLRPKEGLAIMNGTSVMTALACLAYGRADYLTRLVTRITALASFALDGNAHHFDATLFSVKPHPGQQRVAGWLRQDLACDQLDPNGKRLQDRYSIRCAPHVIGVLADALPWLRDSIENELNSANDNPIIDAEGERVFYGGHFYGGHIGFAMDSMKNAVANLADLLDRQMALLVDSRYSNGLPANLSGVQGPRAAINHGLKGLQISTSAWTAEALKLTMPASVFSRSTECHNQDKVSMGTIAARDCLRVLELTEQVAAALLITVRQGAWLRCRLNRSVAPEATLKNMMDALGADIAEIEEDRRLEPDLRLLLERIRDRAWKLYE

SEQ ID NO: 217 - DNA, 1566 bp, Unknown
  Obtained from environmental sample
atgcatcccgttgacttgaagaagagcccaacctcaattcgtacgattagattcgacgatggacgactgaaaatcgaggatattgtcgatattgcggaagggtcggctagggtagcactgcccgaggcttatgaattccgctccgccatcgcgcgaggggcggactttctggatcgtctgctgcgcgaagagggcacgatttatggcgtcaccaccggctacggcgattcatgcaccgtgccggtcccgcttgagctggtcgccgagttgccgcgccagctctacacttatcacggctgtgggctaggcgagtatttgagtccggtacagacgcgggccgtgatggccacccgccttacatcgttgtgcaaaggattctccggcgtcagtctggaactgctgcatcaactcgtgaggttgctgcagtgtgatttactgccattgattccatctgaaggttcggtgggggccagcggcgatctcaccccactatcccatctcgctgccgtgttgtgcggcgagggcgaagtttggcgtaacggcgttcatgcaaacgccgcgcaagcactggccgaggccggtattacaccgctccggttgaggccaaaggaaggactggcgatcatggatgggacgtcggtcatgaccgccttggcgtgccttgcttatacgcgggccgattacctcacgcggctagtcactcggatcaccgccttagcgtcgtttgcgctggacggcaatgcgcaccatttcgatgctacgttgttctcagtgaagcctcacccaggccagcagcgggtggcgggttggttgcgtcaagacttagcgtgcgatcacctggaccccaatggaaagcgtctccaggatcgctactcgatccgttgcgcgccccacgtgatcggtgttctcgccgatgcgctgccatggttgcgtgaatatatcgaaaatgaacttaacagcgccaacgataatcccatcatcgacgcggagggcgaacgcgtactctatggcggtcacttctacggggggcatattggatttgccatggacagcatgaaaaatgccgtcgcaaacctggcggatctgcttgaccggcagatggctctgctggtcgacagccggtatagcaacggcttgccggccaacttgtctggggttcaaggaccacgtgcagcgatcaatcatggcctcaaggggttgcagatcagtacttcggcatggaccgcggaggcgctcaagttgaccatgccggcatcggtgttctcgcgttcgaccgagtgccacaatcaggacaaagtcagcatgggcaccgttgcggcacgcgattgtttgcgggtgctcgaattgacggagcaagtcgccgcggcgctgctgatcgccgtgcgacagggagtctggctccgttgcaggctgaatcgatccgttgttcccgaggcgacgttgaagaaaatgatagacgccttgggcgctgatatcgctgagatcgaggaagaccgcaggctagagtcggatttgcgattactgctggagcgcatccgcgaccgtgtatggaaattgtatgactaa

SEQ ID NO: 218 - protein, 521 aa, Unknown
  Obtained from environmental sample
MHPVDLKKSPTSIRTIRFDDGRLKIEDIVDIAEGSARVALPEAYEFRSAIARGADFLDRLLREEGTIYGVTTGYGDSCTVPVPLELVAELPRQLYTYHGCGLGEYLSPVQTRAVMATRLTSLCKGFSGVSLELLHQLVRLLQCDLLPLIPSEGSVGASGDLTPLSHLAAVLCGEGEVWRNGVHANAAQALAEAGITPLRLRPKEGLAIMDGTSVMTALACLAYTRADYLTRLVTRITALASFALDGNAHHFDATLFSVKPHPGQQRVAGWLRQDLACDHLDPNGKRLQDRYSIRCAPHVIGVLADALPWLREYIENELNSANDNPIIDAEGERVLYGGHFYGGHIGFAMDSMKNAVANLADLLDRQMALLVDSRYSNGLPANLSGVQGPRAAINHGLKGLQISTSAWTAEALKLTMPASVFSRSTECHNQDKVSMGTVAARDCLRVLELTEQVAAALLIAVRQGVWLRCRLNRSVVPEATLKKMIDALGADIAEIEEDRRLESDLRLLLERIRDRVWKLYD

SEQ ID NO: 219 - DNA, 1563 bp, Unknown
  Obtained from environmental sample
atgcccgttgacttgaagaagtgctcaacctcagtccgtacgattcaattcgaccgtggacggctgaagatcgaggatattgtcgatatctcggaagggtcggttcgcgtagcactgtccaatgcttctgaatttcgttccgccattgcgcgaggggcggactttttggatcgtctgctgcgcgaagagggcacgatttatggcgtcaccaccggctacggcgattcatgcaccgtggcggtttcgcctgagctggtcgccgagttgccgcgccagctctatgtctatcacggctgtgggctgggcgagtatttgagtccgctacagacgcgggccgtgatcgcaacccgcctcgcatcgttgtgcaaaggactctctggcgtcagtctggaactgctgcatcaactcgtgaggttgctgcagtacgatttattgccattgattccatctgaaggttcggtgggggctagcggcgatctcactccgctatcctatcttgctgccgtgttgtgtggcgagggcgaagtttggcgcaacggcgtccatgtaagcgcagcgcacgcactggctgaggccggtatcgcaccgctgcggttgaggccaaaagaaggactggcgattatgaatgggacgtccgtcatgaccggtttggcgtgccttgcttatgggcgcgccgattacctcacgcggctagttactcacatcacggcattggcgtcgtttgcgctggacggcaatgcgcatcatttcgatgctacgttgttctcagtgaagccgcatccaggccagcagcgggtggccggttggttgcgtcaagacttggcgtgcgatcagctggaccccaacggaaagcgcctccaggatcgctactcgatccgttgcgccccacacgtgatcggtgttctcgccgatgccctgccatggttgcgcgactccatcgaaaatgaactcaacagcgccaacgacaatccgatcatcgatgcggagggcgaacgcgtgctctatggcggtcacttctatggggggcatattggatttgccatggacagcatgaaaaatgccgtcgcaaacctggcggatctgcttgaccgccaaatggcactactggtcgacagccgctatagcaacggcttgccggccaatttatctggtgttcaagggccacgtgcggcgatcaatcatgggctcaaggggctgcagatcagtacttcggcatggacggcagaagccctcaagttgaccatgccggcgtcagtgttctcgcgttcgaccgagtgccacaaccaggacaaagtcagcatgggtaccattgcggcacgcgattgtttgcgtgtcctcgaattgactgagcaagtcgccgcggcgctgctgatcactgtgcgacagggagcctggctccgttgcaggctgaatcgatccgtcgctccagaggcgacgttgaagaacatgatggacgccttgggcgctgatatcgctgagattgaggaggaccgcaggctagagccggatttgcgattactgctggagcggatccgcgaccgtgcctggaaattgtatgaataa

SEQ ID NO: 220 - protein, 520 aa, Unknown
  Obtained from environmental sample
MPVDLKKCSTSVRTIQFDRGRLKIEDIVDISEGSVRVALSNASEFRSAIARGADFLDRLLREEGTIYGVTTGYGDSCTVAVSPELVAELPRQLYVYHGCGLGEYLSPLQTRAVIATRLASLCKGLSGVSLELLHQLVRLLQYDLLPLIPSEGSVGASGDLTPLSYLAAVLCGEGEVWRNGVHVSAAHALAEAGIAPLRLRPKEGLAIMNGTSVMTGLACLAYGRADYLTRLVTHITALASFALDGNAHHFDATLFSVKPHPGQQRVAGWLRQDLACDQLDPNGKRLQDRYSIRCAPHVIGVLADALPWLRDSIENELNSANDNPIIDAEGERVLYGGHFYGGHIGFAMDSMKNAVANLADLLDRQMALLVDSRYSNGLPANLSGVQGPRAAINHGLKGLQISTSAWTAEALKLTMPASVFSRSTECHNQDKVSMGTIAARDCLRVLELTEQVAAALLITVRQGAWLRCRLNRSVAPEATLKNMMDALGADIAEIEEDRRLEPDLRLLLERIRDRAWKLYE

SEQ ID NO: 221 - DNA, 1563 bp, Unknown
  Obtained from environmental sample
atgcccgttgacttgaagaagagctcaacctcagtccgtacgattcaattcgacgatggacggctgaaaatcgaggatattgtcgatatctcggaagggtcggttcgcgtagcactgtccaatgcttctgaatttcgttccgccactgcgcgaggggcggactttttggatcgtctgctgcgcgaagagggcacgatttatggcgtcaccaccggctacggcgattcatgcaccgtggcggtcccgcctgagctggtcgccgagttgccgcgccagctctatgtctatcacggctgtgggctgggcgagtatttgagtccgctacagacgcgggccgtgatcgccacccgcctcacatcgttgtgcaaaggactctctggcgtcagtctggaactgctgcatcaactcgtgaggttgctgcagtacgatttattgccattgattccatctgaaggttcggtgggggctagcggcgatctcactccgctatcctatctcgctgccgtgttgtgcggcgagggcgaagtttggcgcaacggcgtccatgttagcgcagcgcacgcactggctgaggccggtatcgcaccgctgcggttgaggccaaaagaaggactggcgattatgaatgggacgtccgtcatgaccgctttggcgtgccttgcttatgggcgcgccgattacctcacgcggctagttactcgcatcacggcattggcgtcgtttgcgctggacggcaatgcgcatcatttcgatgctacgttgttctcagtgaagccgcatccaggccagcagcgggtggccggttggttgcgtcaagacttggcgtgcgatcagctggaccccaacggaaagcgcctccaggatcgctactcgatccgttgcgccccacacgtgatcggtgttctcgccgatgccctgccatggttgcgcgactccatcgaaaatgaactcaacagcgctaacgacaatccgatcatcgatgcggagggcgaacgcatgctctatggcggtcacttctatggggggcatattggatttgccatggacagcatgaaaaatgccgtcgcaaacctggcggatctgcttgaccggcaaatggcactgctggtcgacagccgctatagcaacggcttgccggccaatttatctggggttcaagggccacgtgcggcgatcaatcatgggctcaaggggttgcagatcagtacttcggcatggacggcagaagccctcaagttgaccatgccggcgtcagtgttctcgcgttcgaccgagtgtcacaaccaggacaaagtcagcatgggtaccattgcggcacgcgattgtttgcgtgtgctcgaattgactgagcaagtcgccgcggcgctgctgatcaccgtgcgacagggaacctggctccgttgcagactgaatcgatccgtcgctccagaggcgacgttgaagaacatgatggacgccttgggcgctgatatcgctgagattgaggaggaccgcaggctagagccggatttgcgattactgctggagcggatccgcgaccgtgcctggaaattgtatgaataa

SEQ ID NO: 222 - protein, 520 aa, Unknown
  Obtained from environmental sample
MPVDLKKSSTSVRTIQFDDGRLKIEDIVDISEGSVRVALSNASEFRSATARGADFLDRLLREEGTIYGVTTGYGDSCTVAVPPELVAELPRQLYVYHGCGLGEYLSPLQTRAVIATRLTSLCKGLSGVSLELLHQLVRLLQYDLLPLIPSEGSVGASGDLTPLSYLAAVLCGEGEVWRNGVHVSAAHALAEAGIAPLRLRPKEGLAIMNGTSVMTALACLAYGRADYLTRLVTRITALASFALDGNAHHFDATLFSVKPHPGQQRVAGWLRQDLACDQLDPNGKRLQDRYSIRCAPHVIGVLADALPWLRDSIENELNSANDNPIIDAEGERMLYGGHFYGGHIGFAMDSMKNAVANLADLLDRQMALLVDSRYSNGLPANLSGVQGPRAAINHGLKGLQISTSAWTAEALKLTMPASVFSRSTECHNQDKVSMGTIAARDCLRVLELTEQVAAALLITVRQGTWLRCRLNRSVAPEATLKNMMDALGADIAEIEEDRRLEPDLRLLLERIRDRAWKLYE

SEQ ID NO: 223 - DNA, 1542 bp, Pseudomonas stutzeri ATCC 14405
atgaccccgcatcttgagccggtaatttttggcgaacgccacctgccaatcgaagacgtgctggccttggccaaccgtcaggcgcccacgcaattgcaggatgacgctgcctatcgccagcgcatcgccaagggcgcgcagttcctcgactcgctgctggacaaggaaggcgtgatctatggcgtgactaccggctacggcgactcctgcgtggtggcggtgccgttgcagcacgtcgaggcgttgccacgtcacctctacaccttccacggttgcggcctgggcaagttgctcgacgcccaagccacccgcgccgtgctcgccgcacgcttgcagtcgctgtgccatggtgtgtccggcgtgcgcgtggagttgctggagcgcctgcatgccttcctcgaacacgacgtgctgccgctgattccggaagaaggctcggtgggcgccagcggtgatctgacgccgctgtcctacgtggcggcgaccctgtccggtgagcgcgaagtactgttccgtggcgaacgccgccaggctgccgacgtgcaccgcgaactgggttgggagccgctggtattgcgccccaaagaagccctggccttgatgaacggcaccgccgtaatgaccggccttgcctgcctggccttcgcccgcgccgactacctgctgcaactggccacgcgcatcaccgcgttgaacgtggtggcgctgcaaggcaacccggaacacttcgacgagcgcctgttcgccgccaagccgcacccggggcagatgcaagtggccgcctggctgcgcaaggacctggcgatcgatgcaccgactgcgccgctgcatcgtttgcaggatcgctactcgctgcgctgcgcgccccatgtgccgggcgtgctggccgacagccttaactggctgcgctcgttcattgaaatcgagctgaacagtgccaacgataacccgatcatcgacgccgaagaagagcgcgtgctgcacggcgggcacttctacggcgggcatatcgcctttgccatggacagcctcaagaccctggtggctaacgtcgccgacctgctcgaccgtcagctcgcgctgctggtggatgtgcgttacaaccacggcctgccgagcaacctgtccggcgcgccggccgaccgcgcgatgatcaaccacggcttcaaggccgtgcagatcggcaccagcgcctggaccgccgaagcgctgaaaaacaccatgccggccagcgtgttctcgcgttccaccgaatgccataaccaggacaaggtgagcatgggcaccatcgccgcccgcgacgcaatccgcgtgctggagctgaccgaacaggtcgccgccgccaccttgctcgccgccaaccagggcgtgtggttgcgcgcccaggctgaagacgcacgcccactgccaccagcactggcggccatgcatatcgagctggccaaagacttcccgccggtgatcgaagaccgcgcattggaaggcgaactgcgcctgtgcctcaaacgtatcgccgagcaacactggaggctgcatgcgtag

SEQ ID NO: 224 - protein, 513 aa, Pseudomonas stutzeri ATCC 14405
  DOMAIN (6)...(485): Phenylalanine and histidine ammonia-lyase
MTPHLEPVIFGERHLPIEDVLALANRQAPTQLQDDAAYRQRIAKGAQFLDSLLDKEGVIYGVTTGYGDSCVVAVPLQHVEALPRHLYTFHGCGLGKLLDAQATRAVLAARLQSLCHGVSGVRVELLERLHAFLEHDVLPLIPEEGSVGASGDLTPLSYVAATLSGEREVLFRGERRQAADVHRELGWEPLVLRPKEALALMNGTAVMTGLACLAFARADYLLQLATRITALNVVALQGNPEHFDERLFAAKPHPGQMQVAAWLRKDLAIDAPTAPLHRLQDRYSLRCAPHVPGVLADSLNWLRSFIEIELNSANDNPIIDAEEERVLHGGHFYGGHIAFAMDSLKTLVANVADLLDRQLALLVDVRYNHGLPSNLSGAPADRAMINHGFKAVQIGTSAWTAEALKNTMPASVFSRSTECHNQDKVSMGTIAARDAIRVLELTEQVAAATLLAANQGVWLRAQAEDARPLPPALAAMHIELAKDFPPVIEDRALEGELRLCLKRIAEQHWRLHA

SEQ ID NO: 225 - DNA, 1545 bp, Unknown; identical to SEQ ID NO: 157
  Obtained from environmental sample

SEQ ID NO: 226 - protein, 514 aa, Unknown; identical to SEQ ID NO: 156
  Obtained from environmental sample
  DOMAIN (8)...(486): Phenylalanine and histidine ammonia-lyase

SEQ ID NO: 227 - DNA, 1542 bp, Unknown
  Obtained from environmental sample
atgaccccgcatcttgagccggtaatttttggcgaacgccacctgccaatcgaagacgtgctggccttggccaaccgtcaggcgcccacgcaattgcaggatgacgctgcctatcgccagcgcatcgccaagggcgcgcagttcctcgactcgctgctggacaaggaaggcgtgatctatggcgtgactaccggctacggcgactcctgcgtggtggcggtgccgttgcagcacgtcgaggcgttgccacgtcacctctacaccttccacggttgcggcctgggcaagttgctcgacgcccaagccacccgcgccgtgctcgccgcacgcttgcagtcgctgtgccatggtgtgtccggcgtgcgcgtggagttgctggagcgcctgcatgccttcctcgaacacgacgtgctgccgctgattccggaagaaggctcggtgggcgccagcggtgatctgacgccgctgtcctacgtggcggcgaccctgtccggtgagcgcgaagtactgttccgtggcgaacgccgccaggctgccgacgtacaccgcgaactgggttgggagccgctggtattgcgccccaaagaagccctggccttgatgaacggcaccgccgtaatgaccggccttgcctgcctggccttcgcccgcgccgactacctgctgcaactggccacgcgcatcaccgcgttgaacgtggtggcgctgcaaggcaacccggaacacttcgacgagcgcctgttcgccgccaagccgcacccggggcagatgcaagtggccgcctggctgcgcaaggacctggcgatcgatgcaccgactgcgccgctgcatcgtttgcaggatcgctactcgctgcgctgcgcgccccatgtgctgggcgtgctggccgacagccttaactggctgcgctcgttcattgaaatcgagctggacagtgccaacgataacccgatcatcgacgccgaagaagagcgcgtgctgcacggcgggcacttctacggcgggcatatcgcctttgccatggacagcctcaagaccctggtggctaacgtcgccgacctgctcgaccgtcagctcgcgctgctggtggatgtgcgttacaaccacggcctgccgagcaacctgtccggcgcgccggccgaccgcgcgatgatcaaccacggcttcaaggccgtgcagatcggcaccagcgcctggaccgccgaagcgctgaaaaacaccatgccggccagcgtgttctcgcgttccaccgaatgccataaccaggacaaggtgagcatgggcaccatcgccgcccgcgacgcaatccgcgtgctggagctgaccgaacaggtcgccgccgccaccttgctcgccgccaaccagggcgtgtggttgcgcgcccaggctgaagacgcgcgcccactgccaccagcactggcggccatgcatatcgagctggccaaagacttcccgccggtgatcgaagaccgcgcattggaaggcgaactgcgcctgtgcctcaaacgtatcgccgagcaacactggaggctgcatgcgtag

SEQ ID NO: 228 - protein, 513 aa, Unknown
  Obtained from environmental sample
  DOMAIN (6)...(485): Phenylalanine and histidine ammonia-lyase
MTPHLEPVIFGERHLPIEDVLALANRQAPTQLQDDAAYRQRIAKGAQFLDSLLDKEGVIYGVTTGYGDSCVVAVPLQHVEALPRHLYTFHGCGLGKLLDAQATRAVLAARLQSLCHGVSGVRVELLERLHAFLEHDVLPLIPEEGSVGASGDLTPLSYVAATLSGEREVLFRGERRQAADVHRELGWEPLVLRPKEALALMNGTAVMTGLACLAFARADYLLQLATRITALNVVALQGNPEHFDERLFAAKPHPGQMQVAAWLRKDLAIDAPTAPLHRLQDRYSLRCAPHVLGVLADSLNWLRSFIEIELDSANDNPIIDAEEERVLHGGHFYGGHIAFAMDSLKTLVANVADLLDRQLALLVDVRYNHGLPSNLSGAPADRAMINHGFKAVQIGTSAWTAEALKNTMPASVFSRSTECHNQDKVSMGTIAARDAIRVLELTEQVAAATLLAANQGVWLRAQAEDARPLPPALAAMHIELAKDFPPVIEDRALEGELRLCLKRIAEQHWRLHA

SEQ ID NO: 229 - DNA, 1542 bp, Unknown
  Obtained from environmental sample
atgacgacgcatcttgagccggtaaccttcggcgaaattcccctgcgcatcgaagacgtgctggccctggccaaccgtcaggcgccgactcaactgcaagccgatgccaagtaccgccagcgcatcgccaagggcgcgcagttcctggattcgttgctggacaaggaaggcgtgatctacggcgtgaccaccggctacggcgactcgtgcgtggtggccgtgccgctggagcacgtcgaagcgctgccccgccacctctacacgttccacggctgcggcctgggcaagttgctggatgcgcaagccacccgcgcggtgctggcggcgcggttgcagtcgctgtgccatggcgtgtcgggcgtgcgcgtggagttgctggagcgcctgcacgcgttcctggaatttgacgtgctgccgctgattccggaagaaggctcggtaggcgccagcggtgacttgacgccgctgtcctacgtggccgcaaccttgtctggtgagcgcgaagtgctgttccgtggcaaacgccgccaggcggcggaggtgcaccgcgagctgggctgggacccgctggtgctgcgcccgaaagaggccctggcactgatgaacggcaccgccgtgatgaccggcctcgcctgcctggccttcgcccgcgccgactacctgctgcaactggccacgcgcatcaccgcgctgaacgtggtggcgctgcaaggcaacccggagcatttcgacgagcgcctgtttgccgccaagccgcacccggggcagatgcaagtcgccgcctggctgcgcaaggatctggccatcgacgcgccgaccgcgccgctgcatcgcctgcaagaccgttactccctgcgctgcgccccccacgtcctgggcgtgctggccgacagcctgaactggttgcgctcgttcatcgagatcgaactcaacagcgccaacgacaacccgatcatcgacgccgaagaagaacgcgtgctgcacggcggccacttctacggcggccacatcgccttcgccatggacagcctcaagaccctggtggccaacgtcgccgacctgctggaccgccagctcgcgctgctggtggacgtgcgttacaaccacggcttgccgagcaatttgtccggtgcgccagccgagcgggcgatgatcaaccacggcttcaaggctgtgcagatcggcaccagcgcctggaccgccgaagcgctgaaaaacaccatgccggccagcgtgttctcgcgctccaccgagtgccacaaccaggacaaggtgagcatgggcaccatcgccgcccgcgatgcgattcgtgtgctggaactgaccgaacaagtcgccgccgccaccttgctcgccgccaaccagggcgtatggctacgggcccaggctgaagatgcgcgcccgctgccgccggcgctggccgccatgcacgacgaactggccaaggacttcccgccggtcatcgaagaccgcgccctggaaggcgaactgcgcctgtgcctcaagcgtatcgccgagcaacactggaggctgcatgcgtag

SEQ ID NO: 230 - protein, 513 aa, Unknown
  Obtained from environmental sample
  DOMAIN (2)...(485): Phenylalanine and histidine ammonia-lyase
MTTHLEPVTFGEIPLRIEDVLALANRQAPTQLQADAKYRQRIAKGAQFLDSLLDKEGVIYGVTTGYGDSCVVAVPLEHVEALPRHLYTFHGCGLGKLLDAQATRAVLAARLQSLCHGVSGVRVELLERLHAFLEFDVLPLIPEEGSVGASGDLTPLSYVAATLSGEREVLFRGKRRQAAEVHRELGWDPLVLRPKEALALMNGTAVMTGLACLAFARADYLLQLATRITALNVVALQGNPEHFDERLFAAKPHPGQMQVAAWLRKDLAIDAPTAPLHRLQDRYSLRCAPHVLGVLADSLNWLRSFIEIELNSANDNPIIDAEEERVLHGGHFYGGHIAFAMDSLKTLVANVADLLDRQLALLVDVRYNHGLPSNLSGAPAERAMINHGFKAVQIGTSAWTAEALKNTMPASVFSRSTECHNQDKVSMGTIAARDAIRVLELTEQVAAATLLAANQGVWLRAQAEDARPLPPALAAMHDELAKDFPPVIEDRALEGELRLCLKRIAEQHWRLHA

SEQ ID NO: 231 - DNA, 1563 bp, Unknown
  Obtained from environmental sample
atgatttttggaagaccgatgacgacgccaacccatgagccggtaaccttcggcgaacgccctttgcgcatcgaagacgtgctggccctggccaaccgtcaggcgcccgtgcagttgcagagcgacgccgattaccgtgaacgcatcgccaagggcgcgcggttcctcgattcgctgctggacaaggaaggcgtgatctacggcgtcaccaccggttacggcgactcctgcgtggtcgcggtgccgctgcatcacgtcgaggcgctgccgcgtcatctctacaccttccacggttgcgggctgggcaacctgctcgacgcccaggccacccgcgcggtgctggcggcgcgtttgcagtcgctgtgccacggcgtgtccggagtgcgcatcgagctgctggaacgtctgcatgccttcctcgaacacgacatcctgccactgatccccgaagagggttcggtgggcgccagcggcgatctgacgccgctctcctacgtcgccgcgaccctgtccggcgagcgcgaagtgatgttccgtggcgaacgccgccagtccgccgatgtgcatcgcgaactcggctggacgccgctggtgctgcgcccgaaagaagcgctggcactgatgaacggcaccgccgtgatgaccggtcttgcctgcctggcctatgcccgcgccgattacctgctgcaactggccacccgcatcactgcgttgaacgtggtggcgctgcaaggcaatccggagcacttcgacgagcgcctgttcgccgccaagccgcacccggggcagatgcaggtcgccgcgtggctgcgcaaggatctggcgatcgacgcaccgaccgcgccgctgcaccggttgcaggaccgctactcgctgcgctgcgctccgcacgtgctcggcgtattggccgacagcctgaactggctgcgttcgttcatcgagaccgaactgaacagcgccaacgacaacccgatcatcgacgccgaagccgagcgcgtgctgcacggcgggcacttctacggcgggcatatcgccttcgccatggacagcctgaaaaacctcgtggccaacgtcgccgacctgctcgaccggcaactcgcgctgctggtggatgagcgctacaaccacggtttgccgagcaacctgtccggcgccagcgccgaccgggcaatgctcaaccacggcttcaaggctgtgcagatcggcgccagcgcctggactgccgaagcgttgaaaaacaccatgccggccagcgtcttctcgcgctccaccgagtgccacaaccaggacaaggtgagcatgggcaccatcgccacccgcgacgccattcgcgtgctggagctgaccgaacaggtggccgccgccacgctgctcgcggccaatcagggcgtctggctgcgtggccgcgatgaagatgcacgaccactgccaccgtcgctggccgccatgcacgaagagctggccaaagacttcccgccagtcatcgaagaccgcgccctggaaggcgaactgcgcctgtgcctgcaacgtatcgccgagcaacactggaggctgcatgcgtag

SEQ ID NO: 232 - protein, 520 aa, Unknown
  Obtained from environmental sample
MIFGRPMTTPTHEPVTFGERPLRIEDVLALANRQAPVQLQSDADYRERIAKGARFLDSLLDKEGVIYGVTTGYGDSCVVAVPLHHVEALPRHLYTFHGCGLGNLLDAQATRAVLAARLQSLCHGVSGVRIELLERLHAFLEHDILPLIPEEGSVGASGDLTPLSYVAATLSGEREVMFRGERRQSADVHRELGWTPLVLRPKEALALMNGTAVMTGLACLAYARADYLLQLATRITALNVVALQGNPEHFDERLFAAKPHPGQMQVAAWLRKDLAIDAPTAPLHRLQDRYSLRCAPHVLGVLADSLNWLRSFIETELNSANDNPIIDAEAERVLHGGHFYGGHIAFAMDSLKNLVANVADLLDRQLALLVDERYNHGLPSNLSGASADRAMLNHGFKAVQIGASAWTAEALKNTMPASVFSRSTECHNQDKVSMGTIATRDAIRVLELTEQVAAATLLAANQGVWLRGRDEDARPLPPSLAAMHEELAKDFPPVIEDRALEGELRLCLQRIAEQHWRLHA

SEQ ID NO: 233 - DNA, 1560 bp, Unknown
  Obtained from environmental sample
ttgaattttggaagaccgatgacgacgcatcttgagccggtaaccttcggcgaaattcccctgcgcatcgaagacgtgctggccctggccaaccgtcaggcgccgactcaactgcaagccgatgccaagtaccgccagcgcatcgccaagggcgcgcagttcctggattcgttgctggacaaggaaggcgtgatctacggcgtgaccaccggctacggcgactcgtgcgtggtggccgtgccgctggagcacgtcgaagcgctgccccgccacctctacacgttccacggctgcggcctgggcaagttgctggatgcgcaagccacccgcgcggtgctggcggcgcggttgcagtcgctgtgccatggcgtgtcgggcgtgcgcgtggagttgctggagcgcctgcacgagttcctggaatttgacgtgctgccgctgattccggaagaaggctcggtaggcgccagcggtgacttgacgccgctgtcctacgtggccgcaaccttgtctggtgagcgcgaagtgctgttccgtggcaaacgccgccaggcggcggaggtgcaccgcgagctgggctgggacccgctggtgctgcgcccgaaagaggccctggcactgatgaacggcaccgccgtgatgaccggcctcgcctgcctggccttcgcccgcgccgactacctgctgcaactggccacgcgcatcaccgcgctgaacgtggtggcgctgcaaggcaacccggagcatttcgacgagcgcctgtttgccgccaagccgcacccggggcagatgcaagtcgccgcctggctgcgcaaggatctggccatcgacgcgccgaccgcgccgctgcatcgcctgcaagaccgttactccctgcgctgcgccccccacgtcctgggcgtgctggccgacagcctgaactggttgcgctcgttcatcgagatcgaactcaacagcgccaacgacaaccccatcatcgacgccgaagaagaacgcgtgctgcacggcggccacttctacggcggccacatcgccttcgccatggacagcctcaagaccctggtggccaacgtcgccgacctgctggaccgccagctcgcgctgctggtggacgtgcgttacaaccacggcttgccgagcaatttgtccggtgcgccagccgagcgggcgatgatcaaccacggcttcaaggctgtgcagatcggcaccagcgcctggaccgccgaagcgctgaaaaacaccatgccggccagcgtgttctcgcgctccaccgagtgccacaaccaggacaaggtgagcatgggcaccatcgccgcccgcgatgcgattcgtgtgctggaactgaccgaacaagtcgccgccgccaccttgctcgccgccaaccagggcgtatggctacgggcccaggctgaagatgcgcgcccgctgccgccggcgctggccgccatgcacgacgaactggccaaggacttcccgccggtcatcgaagaccgcgccctggaaggcgaactgcgcctgtgcctcaagcgtatcgccgagcaacactggaggctgcatgcgtag

SEQ ID NO: 234 - protein, 519 aa, Unknown
  Obtained from environmental sample
  DOMAIN (8)...(491): Phenylalanine and histidine ammonia-lyase
MNFGRPMTTHLEPVTFGEIPLRIEDVLALANRQAPTQLQADAKYRQRIAKGAQFLDSLLDKEGVIYGVTTGYGDSCVVAVPLEHVEALPRHLYTFHGCGLGKLLDAQATRAVLAARLQSLCHGVSGVRVELLERLHEFLEFDVLPLIPEEGSVGASGDLTPLSYVAATLSGEREVLFRGKRRQAAEVHRELGWDPLVLRPKEALALMNGTAVMTGLACLAFARADYLLQLATRITALNVVALQGNPEHFDERLFAAKPHPGQMQVAAWLRKDLAIDAPTAPLHRLQDRYSLRCAPHVLGVLADSLNWLRSFIEIELNSANDNPIIDAEEERVLHGGHFYGGHIAFAMDSLKTLVANVADLLDRQLALLVDVRYNHGLPSNLSGAPAERAMINHGFKAVQIGTSAWTAEALKNTMPASVFSRSTECHNQDKVSMGTIAARDAIRVLELTEQVAAATLLAANQGVWLRAQAEDARPLPPALAAMHDELAKDFPPVIEDRALEGELRLCLKRIAEQHWRLHA

SEQ ID NO: 235 - DNA, 1641 bp, Unknown; identical to SEQ ID NO: 51
  Obtained from environmental sample

SEQ ID NO: 236 - protein, 546 aa, Unknown; identical to SEQ ID NO: 52
  Obtained from environmental sample
  DOMAIN (1)...(492): Phenylalanine and histidine ammonia-lyase
  SITE (140)...(156): Phenylalanine and histidine ammonia-lyases signature. Prosite id = PS00488
  SITE (201)...(204): N-glycosylation site. Prosite id = PS00001
  SITE (514)...(517): N-glycosylation site. Prosite id = PS00001

SEQ ID NO: 237 - DNA, 1497 bp, Pseudomonas fluorescens ATCC 13525; identical to SEQ ID NO: 153

SEQ ID NO: 238 - protein, 499 aa, Pseudomonas fluorescens ATCC 13525; identical to SEQ ID NO: 154
  DOMAIN (1)...(471): Phenylalanine and histidine ammonia-lyase
  SITE (133)...(149): Phenylalanine and histidine ammonia-lyases signature. Prosite id = PS00488
  SITE (190)...(193): N-glycosylation site. Prosite id = PS00001
  SITE (365)...(368): N-glycosylation site. Prosite id = PS00001

SEQ ID NO: 239 - DNA, 1557 bp, Unknown
  Obtained from environmental sample
atggagagccctgcgttcaagaacatgagccggacagtacgattcgatagggagtgggtgaagatccaagatatcgttgatattgccgacggagtagcctggcccgtactatctgtgacgccacagttccgctccgcgattgcacaaggcgcggagtttgtcgaccgcctcctgcgtgaagacggcaggatctacggggtgacgacgggttttggcgattcgtgcatggtgacggttggaacggaactcgctgccgagttgccgcgccatctttatacgtatcacggttgtgggctcggggagtatctcacgccggcacagactcgggcagtcatcgcaacccgcttgacttctttatgcaaagggttctccggggtcagtgtcgatctgttggagcaaatggtgcgcttgctgcactgcggtgtgttaccgagaattccctgcgaaggctcggtgggcgccagcggtgatcttacgccgctctcttatctcgccgcggtgctctgcggcgagggcgaagtgtggcgcgacggcgccgcggcacccgcggcagtggctttggctcgtgcccgcatcgcgccattaagcctgcggcccaaggaagctctcgcgatcatgaatggcaccgcagtcatgacggctttggcatgtctcgcttattcgcgcgccgagtatctaagccggctggtgactcgggtgacggcgctggcctcgtttgctttagacggcaatgcctatcacttcgacgagacgctattctcagtcaaacctcatccgggacaacagcgggtagctgcttggctgcgcgccgatttgttctgtgatcgaccgccgcgcaacgccacacgccttcaagaccgttattcgattcgctgcgcgcctcacgtcatcggcgtgctcgccgatgccttaccatggctgtgccagtctatcgagaacgagctgaacagcgccaatgacaatccggttatcgatgcggccggtgaacgggttttatacggcggtcacttttatggcggccacatcgccttcgcgatggatagcatgaaaaacgccgtggctaatttggccgatcttctggaccggcaaatggcgctcctggtggacagccgcttcaacaatggcttgccagccaatctgtccggcatcgagggcccgcggctggcgattaatcatgggctcaaagccctgcagatcagcgcttcggcatggacagcggaagcgctaaagctcaccatgccggcttcggtcttttcgcgttccactgaatgccacaatcaagacaaggtcagcatggggacaattgcagcgcgcgattgcctgcgcattttggaattgaccgagcaagttgtcgccgcgctgttgatcaccgtccggcaaggggtttggcttcgctgcagatcgaatggctctttgagattgcaagcggcgttacagacgatgatgcatcagttggagaacgatgtcgtcgcccttgaggaagaccgacggcttgaaccggacctgcgattacttctggaacgcatccgcagccgcgcgtggaaactctatgagtaa

SEQ ID NO: 240 - protein, 518 aa, Unknown
  Obtained from environmental sample
  SITE (8)...(11): N-glycosylation site. Prosite id = PS00001
  SITE (152)...(168): Phenylalanine and histidine ammonia-lyases signature. Prosite id = PS00488
  SITE (210)...(213): N-glycosylation site. Prosite id = PS00001
  SITE (284)...(287): N-glycosylation site. Prosite id = PS00001
  SITE (384)...(387): N-glycosylation site. Prosite id = PS00001
  SITE (476)...(479): N-glycosylation site. Prosite id = PS00001
MESPAFKNMSRTVRFDREWVKIQDIVDIADGVAWPVLSVTPQFRSAIAQGAEFVDRLLREDGRIYGVTTGFGDSCMVTVGTELAAELPRHLYTYHGCGLGEYLTPAQTRAVIATRLTSLCKGFSGVSVDLLEQMVRLLHCGVLPRIPCEGSVGASGDLTPLSYLAAVLCGEGEVWRDGAAAPAAVALARARIAPLSLRPKEALAIMNGTAVMTALACLAYSRAEYLSRLVTRVTALASFALDGNAYHFDETLFSVKPHPGQQRVAAWLRADLFCDRPPRNATRLQDRYSIRCAPHVIGVLADALPWLCQSIENELNSANDNPVIDAAGERVLYGGHFYGGHIAFAMDSMKNAVANLADLLDRQMALLVDSRFNNGLPANLSGIEGPRLAINHGLKALQISASAWTAEALKLTMPASVFSRSTECHNQDKVSMGTIAARDCLRILELTEQVVAALLITVRQGVWLRCRSNGSLRLQAALQTMMHQLENDVVALEEDRRLEPDLRLLLERIRSRAWKLYE

SEQ ID NO: 241 - DNA, 1557 bp, Unknown
  Obtained from environmental sample
atggagagccctgcgttcaagaacacgacccggacagtacgattcgatagggagtggctgaagatccaggatatcgttgatattgccgacggagtagcctggcccgtactgtctgagacgctacagttccgctccgcgatcgcacaaggcgcggagtttgtcgatcggctcctgcgtgaagacggcaggatctacggggtgacgacgggttttggcgattcgtgcatggtgacggttggaacggaactcgccgccgagttgccgcgccatctttatacgtatcacggttgtgggctcgggtcgtatctcacgccggcacagactcgggcagtcatcgcaacccgcttgacttctttatgcaaagggctctccggggtcagtgtcgaactgttggagcaaatggtgcgcttgctgcactgcggtgtgttaccgagaattccctccgaaggctcggtgggcgccagcggtgatcttacgccgctctcttatctcgccgcggtgctctgcggcgagggcgaagtgtggcgcgacggcgccgcggcacccgcggcagtggttttggctcgtgccggcatcgcgccattaagcctgcggccgaaggaagctctcgcgatcatgaatggtaccgcagtcatgacggctttggcatgtctcgcttactcgcgcgccgagtatctaagccggctggtgactcgggtgacggcgctggcctcgtttgctttagacggcaatgcctatcacttcgacgagacgctattctcagtcaaacctcatccggggcagcagcgggtagctgcttggctgcgcgccgatttgctctgtgatcgaccgccgcgcaacgccacacgccttcaagaccgttattcgattcgctgcgcgcctcacgtcatcggcgtgctcgccgatgccttaccgtggctctgccagtctatcgagaacgagctgaacagcgccaatgacaatccagttatcgatgcggccggtgaacgggttttgtacggcggtcacttttatgggggccacatcgccttcgcgatggatagcatgaaaaacgccgtggctaatttggccgatcttctggaccggcaaatggcgctcctggtggacagccgcttcaacaatggcttgccagccaatctgtccggcatcgagggcccgcggctggcgattaatcatgggctcaaagccctgcagatcagcgcttcggcatggacggcggaagcgctaaagctcaccatgccggcttcggtcttttcgcgttccactgaatgccacaatcaagacaaggtcagcatggggacgattgcagcgcgcgattgcctgcgcgttttggaattgaccgagcaagttgtcgccgcgctgttgatcaccgtccggcaaggggtttggcttcgctgcagatcgaatcgctctttgagattgcaagcggcgttacagacgatgatgcatcagttggagaacgatgtcgtcgcccttgaggaagaccgacggcttgaaccggacctgcgattacttctggaacgcatccgcagccgcgcgtggaaactctatgagtaa

SEQ ID NO: 242 - protein, 518 aa, Unknown
  Obtained from environmental sample
  SITE (8)...(11): N-glycosylation site. Prosite id = PS00001
  SITE (152)...(168): Phenylalanine and histidine ammonia-lyases signature. Prosite id = PS00488
  SITE (210)...(213): N-glycosylation site. Prosite id = PS00001
  SITE (284)...(287): N-glycosylation site. Prosite id = PS00001
  SITE (384)...(387): N-glycosylation site. Prosite id = PS00001
  SITE (476)...(479): N-glycosylation site. Prosite id = PS00001
MESPAFKNTTRTVRFDREWLKIQDIVDIADGVAWPVLSETLQFRSAIAQGAEFVDRLLREDGRIYGVTTGFGDSCMVTVGTELAAELPRHLYTYHGCGLGSYLTPAQTRAVIATRLTSLCKGLSGVSVELLEQMVRLLHCGVLPRIPSEGSVGASGDLTPLSYLAAVLCGEGEVWRDGAAAPAAVVLARAGIAPLSLRPKEALAIMNGTAVMTALACLAYSRAEYLSRLVTRVTALASFALDGNAYHFDETLFSVKPHPGQQRVAAWLRADLLCDRPPRNATRLQDRYSIRCAPHVIGVLADALPWLCQSIENELNSANDNPVIDAAGERVLYGGHFYGGHIAFAMDSMKNAVANLADLLDRQMALLVDSRFNNGLPANLSGIEGPRLAINHGLKALQISASAWTAEALKLTMPASVFSRSTECHNQDKVSMGTIAARDCLRVLELTEQVVAALLITVRQGVWLRCRSNRSLRLQAALQTMMHQLENDVVALEEDRRLEPDLRLLLERIRSRAWKLYE

SEQ ID NO: 243 - DNA, 1557 bp, Unknown
  Obtained from environmental sample
gtggagagccctgcgttcaagaacatgacccggatagtacgattcgatagggagtgggtgaagatccaagatatcgttgatgttgccgacggagtagcctggcccgtactgtctgagacgacacagttccgctccgcgattgcacaaggcgcggagtttgtcgaccgactcctgcgtgaagacggcaggatctacggggtgacgacgggttttggcgattcgtgcatggtgacggttggaacggaactcgccgccgagttgccgcgccatctttatacgtatcacggttgtgggctcggggagtatctcacgccggcacagactcgggcagtcatcgcaacccgcttgacttccttatgcaaagggttctccggggtcagtgtcgaactgttggagcaaatggtgcgcttgctgcactgcggtgtgttaccgagaattccatccgaaggctcggtgggcgccagcggtgatcttacgccgctctcttatctcgccgcggtgctctgcggcgagggcgaagtgtggcgcgacggcgccgcggcacccgcggcagtggctttggctcgtgcccgcatcgcgccattaagcctgcggcccaaggaagctctcgcgatcatgaatggcaccgcagtcatgacggctttggcatgtctcgcttattcgcgcgccgagtatctaagccggctggtgactcgggtgacggcgctggcctcgtttgctttagacggcaatgcctatcacttcgacgagacgctattctcagtcaaacctcatccgggacagcagcgggtagctgcttggctgcgcgccgatttgctctgtgatcgaccgccgcgcaacgccacacgccttcaagaccgttattcgattcgctgcgcgcctcacgtcatcggcgtgctcgccgatgccttaccatggctgtgccagtctatcgagaacgagctgaacagcgccaatgacaatcccgttatcgatgcggccggtgaacaggttttatacggcggtcacttttatggcggccacatcgccttcgcgatggatagcatgaaaaacgccgtggctaatttggccgatcttctggaccggcaaatggcgctcctggtggacagccgcttcaacaatggcttgccagccaatctgtccggcatcgagggcccgcggctggcgattaatcatgggctcaaagccctgcagatcagcgcttcggcatggacggcggaagcgctaaagctcaccatgccggcttcggtcttttcgcgttccactgaatgccacaatcaagacaaggtcagcatggggacaattgcagcgcgcgattgcctgcgcattttggaattgaccgagcaagttgtcgccgcgctgttgatcaccgtccggcaaggggtttggcttcgctgcagatcgaatggctctttgagattgcaagcggcgttacagacgatgatgcatcagttggagaacgatgtcgtcgcccttgaggaagaccgacggcttgaaccggacctgcgattacttctggaacgcatccgcagccgcgcgtggaaactctatgagtaa

SEQ ID NO: 244 - protein, 518 aa, Unknown
  Obtained from environmental sample
MESPAFKNMTRIVRFDREWVKIQDIVDVADGVAWPVLSETTQFRSAIAQGAEFVDRLLREDGRIYGVTTGFGDSCMVTVGTELAAELPRHLYTYHGCGLGEYLTPAQTRAVIATRLTSLCKGFSGVSVELLEQMVRLLHCGVLPRIPSEGSVGASGDLTPLSYLAAVLCGEGEVWRDGAAAPAAVALARARIAPLSLRPKEALAIMNGTAVMTALACLAYSRAEYLSRLVTRVTALASFALDGNAYHFDETLFSVKPHPGQQRVAAWLRADLLCDRPPRNATRLQDRYSIRCAPHVIGVLADALPWLCQSIENELNSANDNPVIDAAGEQVLYGGHFYGGHIAFAMDSMKNAVANLADLLDRQMALLVDSRFNNGLPANLSGIEGPRLAINHGLKALQISASAWTAEALKLTMPASVFSRSTECHNQDKVSMGTIAARDCLRILELTEQVVAALLITVRQGVWLRCRSNGSLRLQAALQTMMHQLENDVVALEEDRRLEPDLRLLLERIRSRAWKLYE

SEQ ID NO: 245 - DNA, 1551 bp, Unknown
  Obtained from environmental sample
atgacacagaacgcgaatccggcgctcatccttttcgatggcagtgcgctgaagatcgagcagatcgcggcgattgcccatcagcaagcgacggtgcagctctcgcccaatccggcttttcgcagtcgcattcagcggggtgcggattttctcgatcggctgctccgcgaagatagtgtcgtgtatggcgtgacgacgggctatggggattcctgcaccgtcgagattccgccggagctgatccaggtactgccgcatcatctctatgcctatcacggctgcggggcagggcgctttctcacggaagtggaaacgcgtgcggtgcttgcgtgccgcctggcatcgctgtgccaggggctgtcgggtgtgagctgggcgctgctcaagcaactggagcatttgctggcgcatgacatcctgccgcgcattccagcggaaggatcggtgggcgcgagcggggatctcacgccgctgtcctatgtcgctgccgtgctgtgtggtgagcgcgatgtgatgtggaaggggcaggtgctgcccgcagcccaagcgctcaaggaaaccggtgcggagccgctgcgcccgcggcctaaggaagggctcgcgctgatgaacggcacggccgtgatgacggcgctggcctgcctggcgtggcagcgtgcagactacgtggcgcgcctcgcatgccgcatcaccgctgcgaacgtggtgggcattgccggcaatgctcatcacttcgatgaaacgttgtttgcggccaaaccgcatgcaggccagcaacgcgcggcggcgcgcatccgaggtgatttggtggcagaggcgccgctgcgcaactcgcatcgtctgcaggatcgttactcgctgcgctgtgcgccgcacgtgatcggagtgctggaagacgcgttgccgtttctgcgccagttgatcgaaggcgaactcaattccgccaacgacaacccgctgatcgaacccgatcaggaacgtgtgctgcatggcggtcacttctacggcgggcatattgcgctggcgatggatacgctcaagaacaccgttgccaacgtagccgatctgttggatcgccagttggcgctactcgtggacacccgctacagtcagggcctgccgtcgaatttgtcggcggcacaaggggcgcgccagcctatcaatcacggcctcaaggcgttgcagatcagtgcgtctgcgtggacggctgaagcgctcaagcagaccatgccagcgtcggtgttctcgcgttccacggaatgccacaaccaggacaaggtgagcatgggcacgattgccgcgcgcgatgcgttgcgcgtgttggagctcaccgaacaagtcattgccgccatgctgattgccgcgcgccaggcggtgccgctgcgtgagcgcattcagccaaatgtgccgatcggcgaccacatgcgcgcctggatcgccgatctggcgggacgtgtggagctggtggaggaagaccgcgcattggatcgcgatttgcagaacctgctggtcgatatccgcgcatctgcctggagcctgtatgccgactga

SEQ ID NO: 246 - protein, 516 aa, Unknown
  Obtained from environmental sample
  DOMAIN (9)...(484): Phenylalanine and histidine ammonia-lyase
MTQNANPALILFDGSALKIEQIAAIAHQQATVQLSPNPAFRSRIQRGADFLDRLLREDSVVYGVTTGYGDSCTVEIPPELIQVLPHHLYAYHGCGAGRFLTEVETRAVLACRLASLCQGLSGVSWALLKQLEHLLAHDILPRIPAEGSVGASGDLTPLSYVAAVLCGERDVMWKGQVLPAAQALKETGAEPLRPRPKEGLALMNGTAVMTALACLAWQRADYVARLACRITAANVVGIAGNAHHFDETLFAAKPHAGQQRAAARIRGDLVAEAPLRNSHRLQDRYSLRCAPHVIGVLEDALPFLRQLIEGELNSANDNPLIEPDQERVLHGGHFYGGHIALAMDTLKNTVANVADLLDRQLALLVDTRYSQGLPSNLSAAQGARQPINHGLKALQISASAWTAEALKQTMPASVFSRSTECHNQDKVSMGTIAARDALRVLELTEQVIAAMLIAARQAVPLRERIQPNVPIGDHMRAWIADLAGRVELVEEDRALDRDLQNLLVDIRASAWSLYAD

SEQ ID NO: 247 - DNA, 1551 bp, Unknown
  Obtained from environmental sample
atgacacagaacgcgaatccggcgctcatcatttttgatggcagcacgctgcagatcgagcagatcacggcgattgcgcatcagcgcgcccaggtgcagctctcgcccgacccggcgtttcgcagccgcattcagcgcggtgcggatcttcttgatcgactgctcagcgaagacggtgtggtgtatggcgtgaccacaggttatggcgattcgtgcacggtggaaatcccgcccgagctgatccccgatctgccgcaccatctctatgcttatcacggctgcggcgcagggcgttttcttaccgaagtggaaacgcgcgccgtgctcgcatgccgtctcgcatcgctgagccgggggctctcgggcgtgagctgggcgctgctcaagcaactggaacatctgatcgtcaacgacatcctgccttgcattcccgccgaaggttcggtgggcgcgagcggcgacctcaccccgctttcctatgttgccgccgtgctgtgcggcgagcgcgatgtgatgtggaaggggcagatcgtttctgccgcgcaagccttgaaggaaacgggcgtggagccgctgcgtctgcgtcccaaggaaggcctggcgctgatgaacggcacggcggtgatgacggcgctcggctgtctcgcatggcagcgcgcggactacgtgtcgcgcctggcctgccgcatcacggcagccaacgtggtgggcattgcgggcaacgcgcatcactttgatgagacgctgttcgccgccaagccgcatgtcggccagcaacgcgctgcgggtcgcattcgcggcgatctggtggccgaggcgccgctgcgcaactcgcaccgtctgcaggatcgctactcgctacgttgcgcgccgcatgtcatcggcgtgctcgaagacgccttgccgtttctgcgccagttgatcgaaagcgagttgaactcggccaacgacaacccgctgatcgaacccgatcaggagcgcgtgctgcatggcgggcatttctacggcggtcacattgcgctcgcgatggacacgctcaagaacacgattgccgacgtggccgatctgctcgatcgccagcttgccttgctggtggacacgcgctacagccaggggttgccttcgaatctgtcggccgcgcaaggcaagacgcaggccatcaaccatggtttgaaggcgctgcagatcagcgcgtcggcgtggaccgcagaagcgctcaagcagaccatgcccgcgtcggtcttctcgcggtcgaccgagtgccacaaccaggacaaggtgagcatgggcacgattgccgcgcgcgatgcgctgcgcgtgctggagctgaccgagcaggtgatcgctgccatgctgatcgccgcgcgccaggccgtgccgctgcgtgaacgcattcagcccgatgtgccgattggcgacgagatgcgtgcgtggatcggcgatctggccgaccgtgtcgccctggtcgaagtggaccgcgcgctcgacaaggatctgcagaagctgctggtcgacattcgcgcgcaagcctggagtctgtatgtcgactga

SEQ ID NO: 248 - protein, 516 aa, Unknown
  Obtained from environmental sample
  DOMAIN (9)...(484): Phenylalanine and histidine ammonia-lyase
MTQNANPALIIFDGSTLQIEQITAIAHQRAQVQLSPDPAFRSRIQRGADLLDRLLSEDGVVYGVTTGYGDSCTVEIPPELIPDLPHHLYAYHGCGAGRFLTEVETRAVLACRLASLSRGLSGVSWALLKQLEHLIVNDILPCIPAEGSVGASGDLTPLSYVAAVLCGERDVMWKGQIVSAAQALKETGVEPLRLRPKEGLALMNGTAVMTALGCLAWQRADYVSRLACRITAANVVGIAGNAHHFDETLFAAKPHVGQQRAAGRIRGDLVAEAPLRNSHRLQDRYSLRCAPHVIGVLEDALPFLRQLIESELNSANDNPLIEPDQERVLHGGHFYGGHIALAMDTLKNTIADVADLLDRQLALLVDTRYSQGLPSNLSAAQGKTQAINHGLKALQISASAWTAEALKQTMPASVFSRSTECHNQDKVSMGTIAARDALRVLELTEQVIAAMLIAARQAVPLRERIQPDVPIGDEMRAWIGDLADRVALVEVDRALDKDLQKLLVDIRAQAWSLYVD

SEQ ID NO: 249 - DNA, 1566 bp, Unknown
  Obtained from environmental sample
atgacgcattcgatttcgcaaccagccaacattcatttaggtcatgtggatttttaccaaggccaactcaccattgagcaagtggttgccattgctaaaggcgcaaaggtcaaattaaacgacagcccagaataccaacactacattgaaaaaggcgcacgctttattgatagcctgttgcatgaagaaggtgtggtttacggtgtcaccacaggttatggcgactcttgcacggttaatgtcagcttagagttggtgcacgaattaccgctgcatttatcccgttttcatggttgtggtttaggggatgtgctaagccctgttcaagcaagggcggtcatggcgtgtcgcctaaattcattggcagtaggaaaatcaggtgtcagctatgccttactgcaacgtatcgaatggttactgaataatgatattacgccagttattccagaggaaggctctgtcggcgccagcggtgatttaacgccattatcttatcttgctgcggtattaattggtgagcgggatgtgatgtatcaaggtcaacgccaaccaaccagcgcggtttatcaggcattcaatataaccccgctaaaacttcgtcccaaagaaggtttagccttaatgaatggcactgcggtgatgaccgccttagcctgtttggcatatgatcgcgcccaatatttatcgcgcttgtctagccgaatcaccgcaatggcttcattaacgttaaaaggaaattcaaaccattttgatgacattctgtttgccgctaaaccgcatcctggccaaagtcaggttgccagctggatacgcgaagatttaaaccatcatactcatccacgaaactcagaccgcctacaagaccgctattcaatccgctgtgcaccgcacattattggggtacttcaagatgcattaccttttatgcgccagtttattgaaaccgagctaaacagtgccaacgataacccgattgtggatgctgaaggcgagcatattctgcacggcggtcatttttatggtggccatattgcctttgtaatggactcgatgaaaaacaccatcgccaatattgccgatttaattgatcggcaaatggcattggtgatggacaccaaatttaataacggcttaccagctaacctttcggccgcaaccggtgaacgtcgcgccatcaaccatggttttaaagcggtacaaattggcgtatccgcctggacagcggaagccctaaaaaacaccatgcccgccagtgtgttttctcgctctactgaatgccacaaccaggataaagtgagcatgggcactattgccgcccgtgattgcatgcgcatattacaactgactgaacaggttgcagcagcggcattattagccatgagtcagggaattcaattacgcattaaccagaatgagttagacgttgatagcctaacgccatcactcgctaaaacccttgctcaggttagcgaagactttgaattacttgtggaagatcgcccattagaagcggtattgcgtcaaaccgttgccaaaatacaacaaggtgcgtgggaggtctgttaa

SEQ ID NO: 250 - protein, 521 aa, Unknown
  Obtained from environmental sample
  DOMAIN (15)...(491): Phenylalanine and histidine ammonia-lyase
  SITE (81)...(84): N-glycosylation site. Prosite id = PS00001
  SITE (154)...(170): Phenylalanine and histidine ammonia-lyases signature. Prosite id = PS00488
  SITE (195)...(198): N-glycosylation site. Prosite id = PS00001
  SITE (212)...(215): N-glycosylation site. Prosite id = PS00001
  SITE (386)...(389): N-glycosylation site. Prosite id = PS00001
MTHSISQPANIHLGHVDFYQGQLTIEQVVAIAKGAKVKLNDSPEYQHYIEKGARFIDSLLHEEGVVYGVTTGYGDSCTVNVSLELVHELPLHLSRFHGCGLGDVLSPVQARAVMACRLNSLAVGKSGVSYALLQRIEWLLNNDITPVIPEEGSVGASGDLTPLSYLAAVLIGERDVMYQGQRQPTSAVYQAFNITPLKLRPKEGLALMNGTAVMTALACLAYDRAQYLSRLSSRITAMASLTLKGNSNHFDDILFAAKPHPGQSQVASWIREDLNHHTHPRNSDRLQDRYSIRCAPHIIGVLQDALPFMRQFIETELNSANDNPIVDAEGEHILHGGHFYGGHIAFVMDSMKNTIANIADLIDRQMALVMDTKFNNGLPANLSAATGERRAINHGFKAVQIGVSAWTAEALKNTMPASVFSRSTECHNQDKVSMGTIAARDCMRILQLTEQVAAAALLAMSQGIQLRINQNELDVDSLTPSLAKTLAQVSEDFELLVEDRPLEAVLRQTVAKIQQGAWEVC

SEQ ID NO: 251 - DNA, 1557 bp, Unknown
  Obtained from environmental sample
atggatcgcgttgataagaaaaagccgcttggcacggtgtgttttgccacggatcgcctgacgatcgaagatatcgtcggcatcgctcattgtgaagcgcgcgcctccctgtccgatgagccggcgtttcgcacttttatcagtcgtggcgcggcctttctagagcgctaccggtgcggcggcggttcggtctatggtgtaactaccggcttcggtgattcctgcaccgccaccgttgcgcccgagctggtagatgaattgccgcatcatctctaccgattccacggctgcggcttgggaaaacattttagtcctttggaaactcgcgcgattgtcgcggcgcgtccggcgtcgctgtgtaagggattctcgggggtcacgatagagctccttgagcaactcactcgactactgcgccaggacattctgccggtaattcccagtgaaggctccgtcggggccagcggcgatctcacctcgctttcatatcttgccgctgtagtttgtggcgaaggcgaggtgtggcgcggtgaagagattgttgccgcagcgccggctctggccggagccggcatcactccgctgcgattgcgtccaaaggaagcgctggcgatcatgaacggaaccgcagtcatgactgcattagcgtgtctggcctacatccgcgcagaatatcttgcccgacttacggctcgtattacagcgctggcctcgtttgctctggatgggaacgccgaacactttgatgctgcgctgtttgcactcaaaccccactctgggcagcaacgcgtcgccgcctggttgcgagcggacttggccagcggagtcggcatgttcgacggcaagcgattgcaggatcgctactcaatccggtgcgcgccccacgttatcggcgtgctggtagacgccttaccgtggctgcggcagttcatagagaacgaactcaacagtgtgaacgacaatccggtcgtggacggcgtcgacgaacgcgtgctgcacggcgggcacttctacggcggccccgtagcgtttgcgatggacagcatgaagaacgcggtggccaatctcgccgatctgctcgatcggcaaatggcactgctagtcgatgcccgttacagcaatggattaccggcgaatctctccggcgtcgaaggtcctcgtgccgcgatcaatcacggcctcaaggcgctgcaaatcagcacttcggcctggtgcgccgaagcgctcaagctgaccatgccggcttccgtattctcgcgctccaccgagtgtcacaaccaggataaggttagcatgggtacgatcgccgcgcgtgattgcctccgggtgttggaattgaccgagcaagtcgcggtgggattgttgatcacgacccgccaagccgtctggtggcgccgccgcttgagtccatcgcttactctcggcgtgtcgctgcaagaaatgctcgacgcgctcagtgccgatgtcgcgttgctcgaagaagaccgccggttggaaccagatctgcggcggcttttggaacgtttacgcggccgcgcctggaggctctatgactaa

SEQ ID NO: 252 - protein, 518 aa, Unknown
  Obtained from environmental sample
  DOMAIN (12)...(490): Phenylalanine and histidine ammonia-lyase
  SITE (210)...(213): N-glycosylation site. Prosite id = PS00001
  SITE (384)...(387): N-glycosylation site. Prosite id = PS00001
MDRVDKKKPLGTVCFATDRLTIEDIVGIAHCEARASLSDEPAFRTFISRGAAFLERYRCGGGSVYGVTTGFGDSCTATVAPELVDELPHHLYRFHGCGLGKHFSPLETRAIVAARPASLCKGFSGVTIELLEQLTRLLRQDILPVIPSEGSVGASGDLTSLSYLAAVVCGEGEVWRGEEIVAAAPALAGAGITPLRLRPKEALAIMNGTAVMTALACLAYIRAEYLARLTARITALASFALDGNAEHFDAALFALKPHSGQQRVAAWLRADLASGVGMFDGKRLQDRYSIRCAPHVIGVLVDALPWLRQFIENELNSVNDNPVVDGVDERVLHGGHFYGGPVAFAMDSMKNAVANLADLLDRQMALLVDARYSNGLPANLSGVEGPRAAINHGLKALQISTSAWCAEALKLTMPASVFSRSTECHNQDKVSMGTIAARDCLRVLELTEQVAVGLLITTRQAVWWRRRLSPSLTLGVSLQEMLDALSADVALLEEDRRLEPDLRRLLERLRGRAWRLYD

What is claimed is:

1. A method for deaminating a phenylalanine, tyrosine, or a histidine comprising the following steps:
    (a) providing a polypeptide having at least 90%, 91%, 92%, 93%, 94%, 95%, 96%, 97%, 98%, 99%, or more, or 100% sequence identity to SEQ ID NO 32, or a fragment thereof, or a polypeptide encoded by a nucleic acid having at least 85%, 86%, 87%, 88%, 89%, 90%, 91%, 92%, 93%, 94%, 95%, 96%, 97%, 98%, 99%, or more, or 100% sequence identity to SEQ ID NO 31;
    (b) providing a composition comprising a phenylalanine, tyrosine, or a histidine residue; and
    (c) contacting the polypeptide or the fragment thereof of step (a) with the composition of step (b) under conditions wherein the polypeptide or the fragment thereof deaminates the phenylalanine, tyrosine, or a histidine residue in the composition;
    wherein the polypeptide or the fragment thereof has lyase activity.

* * * * *